United States Patent 7,745,391 (HUMAN THROMBOSPONDIN POLYPEPTIDE) - sequence listing, part 173

SEQ ID NO: 433715 - DNA, 2206 bp, Homo sapiens
taagcctgtagtcccagctactggggtgaatttcttgaacctgggagggcggaggttgcagtgggccgagatcgcgccactgcactccagcctgggtgacaaaaactccgtctcaaaaaaaaaaaaaaaaaaaaaaaaagagcattaactttgataacttaaaaagagtcacgtgaacatatccactgtccgtgtagattctacatttatttgttgggggcggtaatggggccccttggaggtgtgcgttccgtcgggggccgggaaggcggggcctcacccaatcctggagactcctgcggatgccattatgaggagcaagaacgcgaaggggcctcgggtccgctaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433716 - DNA, 2230 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaaaaacagaagacgaagaagaagaccagcagaaacgcgcgacaccgaaggcagcaaccacgcgacgaagaaccgggcgggaggcaggaacgcaccgaagcaacgagaccagagagggaaagagacacgcggggg

SEQ ID NO: 433717 - DNA, 2479 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaaaaaaaaaaaaaagaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggtatcaaaataaataaatatcacaagaggaagagagaaaacgaaagaaaaacatgtttaagaaagaaagagagtacataatagcaggagagatataaaaaaaacaggacaggggcgagggagcagatataatcagaacacgacagacgagcaggagaccaaacgcgcaacggatgggcaccacatagtagaagagaaacacatctttggagcaggggcaagataaggaagaaacaatacacaaacagcaacgacagaggacgaca

SEQ ID NO: 433718 - DNA, 1927 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggagcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433719 - DNA, 1803 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctgggaccatctccccgaccactgcccagccctctgctccctccccagaggaggcgggagggtgggctctatattttcattccaaataaaattctctttctaaaa

SEQ ID NO: 433720 - DNA, 1848 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctgcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433721 - DNA, 1862 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgtccgccgcccccttcccactcagcttctgccagcgggtcgcaccgggctagctggctgcccagagcctctgaggcagcgcaggggtcagttcccacccccacccgtcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433722 - DNA, 1930 bp, Homo sapiens
  misc_feature (68)..(68): n is a, c, g, or t
ctgcaatccggtgatccggaggccgcgctcattgcgtacgtcgacgtctcacatacgcggcctcacgntgttcacctcacatatgcctctatgctatcaatatgagactagcgcattatacgagtagtacacgtgatatgatagcttcgagagcgaatccgagctcaaataagctgaccaagatgctcatggagtgactattacagcggatgtcccgtgttcatccttgggactagctacactgtcatgcgacgcgtctgacgctcgcgaagattcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433723 - DNA, 2143 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccaggggtgaggaggttctgcttggcctgactgcctgcaatgtgccaggaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433724 - DNA, 1391 bp, Homo sapiens
ggccccagccctctctgcttctgcatagtgacctccagggcaccttgagcaggggctggtgccgctggcaccccagctccccacagtgaggtatgtttcagcacttgcttagtggcctgggcatagtcttaaggcctggaggaggctggaaaagagggaccctgggaataaagtgaagccaggagggccaggtgggggtcgtcatgtgggaaaaggcatagagatggcagagggcccacctgcatttagggacagtgctggctggccttagtgaggccagctaaggcccgtcctggtttgggattagggggtgaggaggttctgcttggcctgactgcctgcaatgtgccaggaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433725 - DNA, 878 bp, Homo sapiens
tgcgccagggaggcccggcgggccatgagaactgtcacgaggcagcccgtgtgggggtctagccaccttaggggtcggcctgcggaggtcgttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433726 - DNA, 1052 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagtagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433727 - DNA, 244 bp, Homo sapiens
ctcatctacaatgtcagctggaaccacaatggcagcctgttttgctcagcatgcaaggacaagagcgtgcgcatcatcgacccccgtcggggcaccctggtggcagtacgtggctctggagggcaaggatggctgtggataggcccaggaccttgagcagggcgctgcactgaccagcctgtccccccgacaggagcgggagaaggctcatgagggggcccggcccatgcgggccatcttcctg

SEQ ID NO: 433728 - DNA, 1474 bp, Homo sapiens
caaaatgtgaaaatccctagaaagcaatagccttcgaggtaccttgcactgaatttcccaccccagcccttccacccgatgggaggctgtaacttgggcactggggtgactttttccatgcccttgtcatctccagggtgggaggcaggccccacttcccctcccctatcccccacttcccattgttgttgccccacccctaatctccagactgaacccagatggagatctgagtgccaaaacaattcttgatgtaactttgtacatatcttctactaccgttgggggctcttggggttagaggtgggggcggctctgtgggccattgctcccctccacctctcaaaagaccttacagtatttcacagtatctctacccgcacgcgagtattacagtatctagctggaatatccccctacagccccccaggaccctatgaggaagggaaggagccagggagagtgaagtaaggtctgggactggggaggtgggatctgaatgaactcatttgcatatcatttgcatcctccgcttggcagccgctttctacaaactcattcactggagtctgggtcccaatcagccgggtccaggactcctctcacacagacacatctccggaggctgggcctcctgaaaagtgtttgcttggggtgtctgtgtaacaacccctccctattcatatttcttggggaccccctacccagccagccagggtgatctgaaaggtatactttgctagctcagtgagctagttcactcaccatgttggtgagcagagagccacacctttccccattttaccttgggaaactcactccaccatctttgccatctcttgaaagtcccttctgcaatctgacctcaatcttttgtgctgcagtttgtccagaggggacacagatgtggggtcagggatgaggattattgaaaaacccatcatctctttttttttccccgtctccctattagccaatccgatctcagagtctctgagtggcctccttgcacccttctcttcagcacccagtaggtgcttaataagtgtttgctgcattgaattatctccctattccttctcatttgccctctagcttcccataccttctccaagtgtcttcctccctttctttgtctggctccctatgactttctatttttttttcctccgtgtggttcccattgttttctgtcctgtctctatcttagtctttgtctgtcttcctcctttcctcaaatgtctcaactctctctccccaatttccccatttaaaaaaaaaaaaaagtgccaaacttccttggaactgagccgctctggggggagaggaccttggatagaggggaggaaatgggaccatttctctttgaggaggtccctaagaggcattgcaaaagtgtggacatggagctaaattgggtcccccttccacagccctcccaccctgagtttttcttagaatctttgtaagaaaa

SEQ ID NO: 433729 - DNA, 2068 bp, Homo sapiens
ggcgggtggcggcgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaa

SEQ ID NO: 433730 - DNA, 738 bp, Homo sapiens
cacccagatcctcccagctcagcggaacatctggctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccaggtggggcctgtttccacttcctgcttcccacaaggccgttctttatacttggggggagttcagccattcaaattgagagtcaaggtcacttcttaaggttttcaagtaatattcagttcttacagtactgtgttagaagaggagaaaaagacctttgtctctcaaaggcatgtcttagagaattaagattaggccagcctgggcaacatagtgagaccctgtccctaacccccgcaaaaaaaaaa

SEQ ID NO: 433731 - DNA, 2355 bp, Homo sapiens
ggcgggtggcggcgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaaaaaaaaaaaaaaaaaaaaaaaaaaaaaaaaaaaaaaagagaaaaaaaaaaaaaaaaaaggggggggggagaagaaaaatgagggggaccaaataatgagagccacgagccgaaacatgagagaaaataggagacaccaaaaagaacgaaaacacagacaaacgacggagacccaaccaaaagccgtactggagacaacacgcacaacgacactagagagaacacctatagcaggcggcgaaaataagagaaaaacccaagacaaaagacagagcaaaaacaagacca

SEQ ID NO: 433732 - DNA, 1975 bp, Homo sapiens
ggcgggtggcggcgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaaccctggtccccttgctgccatgtggatgctgttgtgattgctgtttgtatattatcaaaatgtttttatattaaaaatgtttggtctgaaaattaaaagcacttcatttagaa

SEQ ID NO: 433733 - DNA, 1647 bp, Homo sapiens
cacccagatcctcccagctcagcggaacatctggctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaa

SEQ ID NO: 433734 - DNA, 1891 bp, Homo sapiens
ggcgggtggcggcgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaa

SEQ ID NO: 433735 - DNA, 2037 bp, Homo sapiens
ggcgggtggcggcgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaa

SEQ ID NO: 433736 - DNA, 1037 bp, Homo sapiens
ggcgggtggcggcgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagtcccagctacacaggaggctgaggcaagagaatcgcttgaacccggaaggcagaggttgcagtgagacgagatcacagcattgcactccagcctgggcaacaaaagcaaaactccgtctcaaa

SEQ ID NO: 433737 - DNA, 498 bp, Homo sapiens
ctttgaggagtttcctcaaagatgcttatcttctgtaccttgtatttgagtcagagttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433738 - DNA, 2415 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433739 - DNA, 2358 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaacttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433740 - DNA, 2361 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaagaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433741 - DNA, 2048 bp, Homo sapiens
  misc_feature (1960)..(1960): n is a, c, g, or t
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgagaagaaaacctnccttacttcaatttcttttttggtttttgaatgaaagaaaccatttgtttaggagaaaggaagatttatttagaaaattcttaagtaa

SEQ ID NO: 433742 - DNA, 2679 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433743 - DNA, 3131 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaggaaagtgtatcagtaggtattctggattgaggaaggaaaaagagaaaacaggctagttctattattaaactgtggggttaactaataagtaaagcccaaggcgtccccaaacaccatagggagaaatacgctgcaatttggggaaagtgttgtgaccacagtattcctcatggaaaccattgtcttctggaggcattgacacatatattcaaatgccagcaggaagcaaggaacagtattccgtcttagaaaacttagaacttactcaattttacacatttttttaagtgccagacttgctggaagcgaaaaataattacttagcagttccagaaatctgttgtcagattctagtaattaatggaattctttcttttgtaaaagatcccacttgtgggaaataataagatacatatttaacttgagaatattgtaaaatcctgttcttaaaaaaatacccttttaatgcactaatgtagtatgtaagaaactgcaggggttttgtgcgtgtgtatgtgtgtgtgcatttgagtttcagttttattatccagcatttttgcataatatctccattacccccattagtaataggctattactattatgtttatataaaataaattatgtttatatttattgatagaggactagagaaagggagaaaagggggatatggggaaatcagtttactcatcacagatgtattatatcctagaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433744 - DNA, 1932 bp, Homo sapiens
ggcacgaggcagcactcctccttgctcagttcggtcttgtacaggacctggcagcggccgttcttcgcttgacggagccagcagttcccagcctgggcactgcggtcctccatgaactggcagagcagcagcagcaggaggcaaagcccacccggctggtgcctcgcgcggaccatcctgggggcaggcgcggggcgaggagcgcagcggcgcggggagccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaagtgtatcagtaggtattctggattgaggaaggaaaaagagaaaacagaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433745 - DNA, 406 bp, Homo sapiens
cgctttttatctaatttcaggaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttgacatagcctttgtgc

SEQ ID NO: 433746 - DNA, 2152 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaagtgtatcagtaggtattctggattgaggaaggaaaaagagaaaacagaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaaaaaaattcaattcctg

SEQ ID NO: 433747 - DNA, 1599 bp, Homo sapiens
gcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagtggtcttcatcttcctcctcttcctcggtgtcttccgaaatggagttgcaagatccggagtgctatacttcacagtagcacacctgaggagcaggcagctcccttcatggcacactcgct

SEQ ID NO: 433748 - DNA, 2779 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433749 - DNA, 778 bp, Homo sapiens
gaaaaaaaaaaaaaaaaaaaaaaaaaaaaaactcgaggtcgcggtatcgataagcctgaatcgattccggcacgagaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433750 - DNA, 360 bp, Homo sapiens
tactctagagcatccactctccctactgtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433751 - DNA, 281 bp, Homo sapiens
agagagagagagagagagagagagagagagagagagagagagagagagagagagagagaggttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433752 - DNA, 3500 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433753 - DNA, 3065 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433754 - DNA, 3451 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433755 - DNA, 3183 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433756 - DNA, 3104 bp, Homo sapiens
agagagagagagagagagagagagagagagagagagagagagagagagagagagagagagtttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433757 - DNA, 2276 bp, Homo sapiens
cagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433758 - DNA, 2033 bp, Homo sapiens
  misc_feature (332)..(332): n is a, c, g, or t
cagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgctngtaatcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433759 - DNA, 3052 bp, Homo sapiens
cacgcgtccgcggacgcgtgggtgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgag

SEQ ID NO: 433760 - DNA, 1463 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433761 - DNA, 886 bp, Homo sapiens
cctgtttccgaatttgactccggtacccccccccaacctggaaaaaggcccaaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433762 - DNA, 2223 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctctgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgag

SEQ ID NO: 433763 - DNA, 3141 bp, Homo sapiens
cacgcgtccgcggacgcgtgggtgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433764 - DNA, 2095 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433765 - DNA, 2312 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctctgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433766 - DNA, 2175 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433767 - DNA, 2018 bp, Homo sapiens
tctgttttcttttagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaattaaatctttgc

SEQ ID NO: 433768 - DNA, 2420 bp, Homo sapiens
cacgcgtccgcggacgcgtgggtgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaaaaaaaaaaaaagtatatacacctaacaagagagccccaaaatgtatgaagcaaaaactgacagaactgaagggacaaatagacaattcaatagtaatatttggagacttcaatatcccactttcaataatgaataggacaactaagcaaaagattaacaagaacactgaagacctgaaaagcactataaacaaaactataagctaactagacagaacacacatctacagaacaaaaactccaacc

SEQ ID NO: 433769 - DNA, 456 bp, Homo sapiens
actagtccacggtttggcttatattttttaaaaatcaaaagccaatgaacaacaggatatatagacgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagccaaccgggactagttatagctgcgaactggtgttgcaagctgggctttccccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattacctagagg

SEQ ID NO: 433770 - DNA, 3434 bp, Homo sapiens
aattgcgcaggggcaaaggtcgaggggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcatatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattacctagagg

SEQ ID NO: 433771 - DNA, 2795 bp, Homo sapiens
aattgcgcaggggcaaaggtcgaggggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaaccaggggggggggcccggtacccaaattccccctttggcgggacgttt

SEQ ID NO: 433772 - DNA, 3381 bp, Homo sapiens
aattgcgcaggggcaaaggtcgaggggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcatatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattacctagagg

SEQ ID NO: 433773 - DNA, 904 bp, Homo sapiens
ggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaacagtccttgcatctttcctgtctttaggtacgcaccatctttgctgtctttaagtatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctc

SEQ ID NO: 433774 - DNA, 3380 bp, Homo sapiens
aattgcgcaggggcaaaggtcgaggggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcatatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattacctagagg

SEQ ID NO: 433775 - DNA, 801 bp, Homo sapiens
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctg

SEQ ID NO: 433776 - DNA, 147 bp, Homo sapiens
gcggccgcctactactactactgctcgaattcaagcttctaacgatgtacggggacatgggttggacagtccccacacacattaaattctgtaaatgaaagccaccttttgttaaaaatttgctctaataaaacataccaaatcctg

SEQ ID NO: 433777 - DNA, 2770 bp, Homo sapiens
  misc_feature (1514)..(1514): n is a, c, g, or t
  misc_feature (2006)..(2006): n is a, c, g, or t
  misc_feature (2558)..(2558): n is a, c, g, or t
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttacaagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggacncctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacataaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgncttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatntttattgcgctcaggttatgttccttttacctccttccttaataaagagaccacttgaaataatcagactttttccaagtactgtctgcacctcatcccacctcttccccattcatgagatagtgcagaaccctagcacagtcttttccatatagtaggtgttttttaagtttgttgaattggttgctgtcttgctctgtccttagattatt

SEQ ID NO: 433778 - DNA, 3395 bp, Homo sapiens
  misc_feature (2139)..(2139): n is a, c, g, or t
  misc_feature (2631)..(2631): n is a, c, g, or t
  misc_feature (3183)..(3183): n is a, c, g, or t
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggacgcatgaagagtaccaagcaagaggggagaggtaaagttccacaggagggagtcaggaagatcttcttagaggacggcactcttgagatgagtctcgaaatgagagacttggcctttgagagaaaaaaacagacttccagagcagtatgagcagaggatgaggtgaaactgctacccaagtagtgtgcaacagtgtgttttctgacagcgctatccttagagaatgttacattgatcttgcctacctgcaacaagaaagttcatttggatatatattttttgggtttttttgaatgcacgttttgtgctggacaacaagcaaatacaaaattttaaggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttacaagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggacncctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacataaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgncttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatntttattgcgctcaggttatgttccttttacctccttccttaataaagagaccacttgaaataatcagactttttccaagtactgtctgcacctcatcccacctcttccccattcatgagatagtgcagaaccctagcacagtcttttccatatagtaggtgttttttaagtttgttgaattggttgctgtcttgctctgtccttagattatt

SEQ ID NO: 433779 - DNA, 3056 bp, Homo sapiens
  misc_feature (1800)..(1800): n is a, c, g, or t
  misc_feature (2292)..(2292): n is a, c, g, or t
  misc_feature (2844)..(2844): n is a, c, g, or t
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttacaagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggacncctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacataaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgncttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatntttattgcgctcaggttatgttccttttacctccttccttaataaagagaccacttgaaataatcagactttttccaagtactgtctgcacctcatcccacctcttccccattcatgagatagtgcagaaccctagcacagtcttttccatatagtaggtgttttttaagtttgttgaattggttgctgtcttgctctgtccttagattatt

SEQ ID NO: 433780 - DNA, 2954 bp, Homo sapiens
  misc_feature (1698)..(1698): n is a, c, g, or t
  misc_feature (2190)..(2190): n is a, c, g, or t
  misc_feature (2742)..(2742): n is a, c, g, or t
tgtggtgacgcacttatccggcgcgatgacgtcactgcaaggcgccgggggacacgttggctgcgttttcggcgggcttcccgggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttacaagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggacncctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacataaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgncttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatntttattgcgctcaggttatgttccttttacctccttccttaataaagagaccacttgaaataatcagactttttccaagtactgtctgcacctcatcccacctcttccccattcatgagatagtgcagaaccctagcacagtcttttccatatagtaggtgttttttaagtttgttgaattggttgctgtcttgctctgtccttagattatt

SEQ ID NO: 433781 - DNA, 2716 bp, Homo sapiens
  misc_feature (1460)..(1460): n is a, c, g, or t
  misc_feature (1952)..(1952): n is a, c, g, or t
  misc_feature (2504)..(2504): n is a, c, g, or t
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaatattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttacaagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggacncctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacataaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgncttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatntttattgcgctcaggttatgttccttttacctccttccttaataaagagaccacttgaaataatcagactttttccaagtactgtctgcacctcatcccacctcttccccattcatgagatagtgcagaaccctagcacagtcttttccatatagtaggtgttttttaagtttgttgaattggttgctgtcttgctctgtccttagattatt

SEQ ID NO: 433782 - DNA, 911 bp, Homo sapiens
  misc_feature (911)..(911): n is a, c, g, or t
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaggagcttgaaattgtaattggagatgagcacatatcttttaccacatcaaaaataggttctcttattgatgtaaatcagtcaaagatctgaggctcgagtatttaccatggtcacgatgaagtaggtagtttggtaactcagattaacctaatgtggtcgggggttttaaagggggggggcagctgggtttcggcgcacatgtgttgggaaaaaccggtgttcggggggccattagggggtttcaaaaaaggcgggggtggagaaggtgn

SEQ ID NO: 433783 - DNA, 133 bp, Homo sapiens
tgcaacaagaaagttcatttggatatatattttttgggtttttttgaatgcacgttttgtgctggacaacaagcaaatacaaaattttaaggtacagtaatgagtaagacaaatttaactaaagcagatttgt

SEQ ID NO: 433784 - DNA, 613 bp, Homo sapiens
tatgatgtggttattacaatcataaggatatgaactctttaaatactaaaatgaatactgatgaagaaactattttttcgtatagaaaagatattaattgtatgttcattttagttgtcagcaaaatccttcctttctcctaaattttgttaacttaattgttatgagattttgatttgttttgttttaggcatttaaagaattgttttatcctaggaagaaaaagtaacttttacctttttaaattttagggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctg

SEQ ID NO: 433785 - DNA, 533 bp, Homo sapiens
gtacaaaaatggctgtggctagcgatttctacctgcgctactacgtagggcacaagggcaagtttgggcacgagtttctggagttcgaatttcggccggacggtgagaagaggcccacggcacgcggtgctgggaaaggggagcgagaccgagaggccgggtggtgtggagggtacaggcggcggaggccactgcttccctcgaaggaaataggagcttaagaatagaggaggcataagttggttttataaatgaaagagaattaattgcaataaattaaagctaatcctgtcacaaactgaaaagttgaacctacagtaatcagaattctgtaacagtgcaccagaagggactctagatcgtcgccctgattgaaaatgctagcacttttttgaaaacacccccaccagcgggtggtccagtggatgaataaaatcttgtggtgaccagtacctttttttcatttaggctgtgtgttttctttgaaggggaggagcccaacgtgttaacaaatgagaataataatatgtttt

SEQ ID NO: 433786 - DNA, 1548 bp, Homo sapiens
tgtggtgacgcacttatccggcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctgaaaaaaaaaaaaaaaaaacaaaaaaaacaaaaaaaaaaaaagaaaagagaagaaacaaaacaaaaaaaacaacaacaaaaacaaacaaaaaaagaagaaagaaagagagagacgacagaaagcacgaaaagaaggagacgagcagacgggcgggagagaaggagatgcgagggtgcgagggagaagagaaacgagaggagggaagaggagaggagcaggagaggaggagtgtgtgtaagagaggggggcgggcgcggaagaggaagaaagagtgagggaggagagggacgaagagagagagctggatcgcacgcggacgtagagctgacggacgagggggagtgagaacgaacgatgacacagagatacgaagaggaacggacagagagattcaaagtagcggggcgagcgagaaggagaaggatgggcgagataacagcagggaacgaagagagaggaaagagcaggaacgccgagtagagttgagcgtcacgtctgacgcggaggagcgcagctggaaacaggcaagaaagaggattagagtgggatagcaacgggacgatggaagacgggagaactgacagacaagaagggaacacgaaccgagcaaatgtgcgagagcgatggcgggagtaaggtaccgaggaggcaaaccagaacggaagagacaagaggttgaaaacacgaaacagaagagtagaaggaaatgcaaaacgcaagcagaagtaaagagtaagaatgaaagag

SEQ ID NO: 433787 - DNA, 699 bp, Homo sapiens
tgtggtgacgcacttatccggcgcgatgacgtcactgcaaggcgccgggggacacgttggctgcgttttcggcgggcttcccgggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctg

SEQ ID NO: 433788 - DNA, 9072 bp, Homo sapiens
  misc_feature (4169)..(4169): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433789 - DNA, 9263 bp, Homo sapiens
  misc_feature (92)..(92): n is a, c, g, or t
  misc_feature (4360)..(4360): n is a, c, g, or t
cgtgttctggtaccacatcttagaaccactggttaagatgtagtcatgagaaccaaagaccagaaacgacccgaaaaaatacccatcgacanaatctggtggaagaaatcacgatcgatatacacaatggaattctatgcaactattaaaaggaatgcagaagagttccatgttctgttctaggatatcctccaggctggtcttgaactcctggtctcaaacattctaactgccttagccacccaaagtgttagcattacaggtgtgaaccaccacgcccagccaataaaattattatgtagtttttaaaatgtaagagtatttaatcatttacctggactcatatctacccaatttttgtctaatttaagcctgtgttgtgcctgcatatgaatgttgtatataatttttatcttcggatatagttggaaacattagcttatttgcctcaaagagatgacaggaattcagaaaatattgctggttctgctactgaatcctatagtaacaaaaattagtgcaattaagttgcaacattgcatatcagaagttttaatttctgtttgcttaaatggtaatgattaatcctaattggatgcctacattttcagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433790 - DNA, 8470 bp, Homo sapiens
  misc_feature (3567)..(3567): n is a, c, g, or t
aacgatggtcctcacgcttctcttagacatcaccatccttggtcccttctgatttcctctttccccatcatctccgggagtcaaagtcagctccttcaacgctatttcaatcccacagccacaatcttagtctaggctttccccttccttcagcctagattactgcacagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433791 - DNA, 8790 bp, Homo sapiens
  misc_feature (4169)..(4169): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433792 - DNA, 9027 bp, Homo sapiens
  misc_feature (4124)..(4124): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433793 - DNA, 2463 bp, Homo sapiens
gcggccgcctactactactactgctcgaattcaagcttctaacgatgtacggggacatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433794 - DNA, 1090 bp, Homo sapiens
gctcgggcccagctcagtaagttgaaaatggtcctaagcagactccgagaaaattgggtggatcagtgcacgtgagggtgcctttgcgcttatcctactgctcatactaataaacacatagccacacggctgaggtttgaacacggaagcagattacgttgagagctaaatacaatgtatggtagattgcttgagagtcaattaggcttgtgcagtcatatctactctgggtagattctatagtctgtagtcctcgaatgtctatatataatctgtgactgcaaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433795 - DNA, 5693 bp, Homo sapiens
  misc_feature (4169)..(4169): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacgacagaaaatagcaccagagaggaagttaatgagagacagtcccatccagctacgcagcagcagctgggcaaaccttgcaagtaagcagctcccccaggttccaggccccttcagctcttttcagctaaggagctgagggactccagcatgacacttcatccgagcgtaccgacctg

SEQ ID NO: 433796 - DNA, 691 bp, Homo sapiens
gaacccaatatggcagcggcggtagcagtggcaacggcagcaagaggaccggccgccccatagacccccccgcgcaccacccccgccgcttcctctgcttggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagaagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaaggtaaatccacctgatccttcaataaagtattaaatgctgtaggacaaaaaaaaa

SEQ ID NO: 433797 - DNA, 9149 bp, Homo sapiens
  misc_feature (4169)..(4169): n is a, c, g, or t
  misc_feature (9020)..(9020): n is a, c, g, or t
  misc_feature (9023)..(9023): n is a, c, g, or t
  misc_feature (9031)..(9031): n is a, c, g, or t
  misc_feature (9034)..(9034): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttancanaccaacancancaacaccaccacacaccacacacacacggggcccgcccaaagaaatccccgcgggcccccaattcgccgcaccacccctccctgcaacacgtgggcccccaagaggggccccaaa

SEQ ID NO: 433798 - DNA, 9138 bp, Homo sapiens
  misc_feature (4235)..(4235): n is a, c, g, or t
gaacccaatatggcagcggcggtagcagtggcaacggcagcaagaggaccggccgccccatagacccccccgcgcaccacccccgccgcttcctctgcttggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagaagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccc

SEQ ID NO: 433799 - DNA, 8815 bp, Homo sapiens
  misc_feature (4169)..(4169): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtga

SEQ ID NO: 433800 - DNA, 7250 bp, Homo sapiens
  misc_feature (4169)..(4169): n is a, c, g, or t
caccacgcccggccaaacatgggtgaatttcttttaaaacctgaaaataaagaattttttttctctgatgcttcttgaagtgtacatgtttatcttttagtctggcaaactcacttctaagaattaacctcagagataagctgtcaaaaatacaaaatggcagagattaagaacaatgattctcagactcgagcttgcgtcagaatcacctacaggacgtatggtgcagattcctgggcctcacttcagagtatctgattcagtagatctgggcttccacccaataattttcatttctaatagatttttaggtagtaatgatgttgttctgggtaccacatcttagaaccactggttaagatgtagtcatgagaacaaaagaccagaaacaacccaaaaaaatacccatcaacaaaatctggtggaagaaatcacgatcgatatacacaatggaattctatgcaactattaaaaggaatgcagaagagttccatgttctgttctaggatatcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaagggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtcnccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgacgaaaacaaaacaaaaaactcgcgggggccgtcccaatcgccaatggagtcgaccatcatgccgcgttaaagtcggacgggaaccgggtaccactagccgtggaaatcctttccggggttagggacgagctcgggcggg

SEQ ID NO: 433801 - DNA, 349 bp, Homo sapiens
cgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaaggtaagagaatggagagaattagaaaagcagagatcgtctgaaccctatgtttttggtcatacctactaaatttcaagtaaattgtggtagttcttaatgcagaagcagttggatatatt

SEQ ID NO: 433802 - DNA, 1656 bp, Homo sapiens
tggttcgggagcacccaagtgaaaggggaagagtgcgacaggcggccctggggtcttcacgccaggcgggcggggtccagccagtatgcagtcgggctggacaggggtctcggtgggacagccttcggggacagcgccatccttgtcgtgccaagcggttacatagctgtctggaaatacgtcctcagctgccccagatcccggaagaaaatctctcccacaccactgtagtcagagaggccagtgggtgcatggaactcctcgcacgcgctgtcagcagcagcagtgaggaagccggcagcacagtctgggaaggaaggaggtgcttggctctctcccgggccgccaccttcgccgtcctcgccatcggtctcatcgtcagtttcctcgtcatcgttgtcacctcggtcgtcaggggccgcggacagtgaggggtaggcaccaagcccctcggctttggcaggtgtcgggggcgcaggcagctgcaaactcgcgggccggcgctgcttaccgctgtgcgcggcaccggggtgccccgggggtgcgcagccagcaggtggcgcaggcggtgacgcagctgctcaggtgcgagtggcgggggcacaggggtgggcaggggcgcgggtgcagaggtgctcgcgggtgcagaggagcgcgtgcgataatctgcgtgcattcgtcgataactgtctatgcgaagcaccgacgcagccatgagtacctgcggggcttcactctgtgccacaacgagcgaaccgctgtacaggagctcgactagctgtcgcaccgtctgcacaggcaccaccgaaggcacacggatctcagaggggccgagcagcagcttgtcttggaaggagggcgagccgattgccagcccgcagcggtgcgcacgcagcgaagcttcatgaatgcacacagtcacgtcgcagaagtgcccacccagcttctgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactactacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatgccaaccaaccaagtaacaaaacaaataagcaaacagccaaccaatcaaccaacaagcaagcaagcaacaaaccaaccaaacaagcaagcaagcaagcaagcaaccaaccaaccaaccaagtaaccgatcaaaccaacccttggagccctttctaaaactttgacctacaaccctgaatccagaatctctgtttagtgggccaacattaataaatttagcctactcca

SEQ ID NO: 433803 - DNA, 2569 bp, Homo sapiens
tggttcgggagcacccaagtgaaaggggaagagtgcgacaggcggccctggggtcttcacgccaggcgggcggggtccagccagtatgcagtcgggctggacaggggtctcggtgggacagccttcggggacagcgccatccttgtcgtgccaagcggttacatagctgtctggaaatacgtcctcagctgccccagatcccggaagaaaatctctcccacaccactgtagtcagagaggccagtgggtgcatggaactcctcgcacgcgctgtcagcagcagcagtgaggaagccggcagcacagtctgggaaggaaggaggtgcttggctctctcccgggccgccaccttcgccgtcctcgccatcggtctcatcgtcagtttcctcgtcatcgttgtcacctcggtcgtcaggggccgcggacagtgaggggtaggcaccaagcccctcggctttggcaggtgtcgggggcgcaggcagctgcaaactcgcgggccggcgctgcttaccgctgtgcgcggcaccggggtgccccgggggtgcgcagccagcaggtggcgcaggcggtgacgcagctgctcaggtgcgagtggcgggggcacaggggtgggcaggggcgcgggtgcagaggtgctcgcgggtgcagaggagcgcgtgcgataatctgcgtgcattcgtcgataactgtctatgcgaagcaccgacgcagccatgagtacctgcggggcttcactctgtgccacaacgagcgaaccgctgtacaggagctcgactagctgtcgcaccgtctgcacaggcaccaccgaaggcacacggatctcagaggggccgagcagcagcttgtcttggaaggagggcgagccgattgccagcccgcagcggtgcgcacgcagcgaagcttcatgaatgcacacagtcacgtcgcagaagtgcccacccagcttctgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactactacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatgccaaccaaccaagtaacaaaacaaataagcaaacagccaaccaatcaaccaacaagcaagcaagcaacaaaccaaccaaacaagcaagcaagcaagcaagcaaccaaccaaccaaccaagtaaccgatcaaaccaacccttggagccctttctaaaactttgacctacaaccctgaatccagaatctctgtttagtgggccaacattaataaatttagcctactccaactttgtgttacttccaccatggtgccacacacttaatatccattcccacatatattctccagatttctttctgtataaattgtgtgtgtgtgtgtgtgtgtgtgtgtgtagaaagagagcatcaactgaaaaatcacacaattttataaatttagaaaagagagctttatttcttataaaggtttgcagcctgcaaggtggccattatgacaggctgggaagtgtggcctacagccaaggctagaggcaggcccttccagggagggaaggagaggacaggaatttgagctgaatgagttgactacatatacatactcaataggatatcagaggagctatatcattttatgagaatactcataaaagaggtcctaacacatgcatattgaataaacatgcatgttcattctggtgtggagacttgacatttaaatgtgttataattaggccctacacatcaaaaagtgaagcagggaatgaaggtactcagcctctgtaaaggcacagcctctaaaactggccagaaccagtccatggaggatggtctcttatcaggagaaagttactgaaatcagtcccttgtccagtgaaagctgtcgttaaggtcggtggggcaggagatcagttactcagtgtctgtgaactgggtgagttgtaattgttttaatcttgcttctctcatagccagtgcttgcttggctgctagagaaaaataaaaactatgtggtagttagaatctagtttattctttaagagtagggtacaagacttaacccttgcctggcatggccctaggtcctgtttataatttggggtcttattgccacaaagagtctgttctgtcagtctcatgatctctattttaacgttaatgctgttcagttgattggtgacgtacacggtgtcacctct

SEQ ID NO: 433804 - DNA, 1114 bp, Homo sapiens
gttaaaacccggtcaacctggcggttaattgaaaaccttcggaaaccaaccaaacaagcaagcaagcaagcaagcaaccaaccaaccaaccaagtaaccgatcaaaccaacccttggagccctttctaaaactttgacctacaaccctgaatccagaatctctgtttagtgggccaacattaataaatttagcctactccaactttgtgttacttccaccatggtgccacacacttaatatccattcccacatatattctccagatttctttctgtataaattgtgtgtgtgtgtgtgtgtgtgtgtgtgtagaaagagagcatcaactgaaaaatcacacaattttataaatttagaaaagagagctttatttcttataaaggtttgcagcctgcaaggtggccattatgacaggctgggaagtgtggcctacagccaaggctagaggcaggcccttccagggagggaaggagaggacaggaatttgagctgaatgagttgactacatatacatactcaataggatatcagaggagctatatcattttatgagaatactcataaaagaggtcctaacacatgcatattgaataaacatgcatgttcattctggtgtggagacttgacatttaaatgtgttataattaggccctacacatcaaaaagtgaagcagggaatgaaggtactcagcctctgtaaaggcacagcctctaaaactggccagaaccagtccatggaggatggtctcttatcaggagaaagttactgaaatcagtcccttgtccagtgaaagctgtcgttaaggtcggtggggcaggagatcagttactcagtgtctgtgaactgggtgagttgtaattgttttaatcttgcttctctcatagccagtgcttgcttggctgctagagaaaaataaaaactatgtggtagttagaatctagtttattctttaagagtagggtacaagacttaacccttgcctggcatggccctaggtcctgtttataatttggggtcttattgccacaaagagtctgttctgtcagtctcatgatctctattttaacgttaatgctgttcagttgattggtgacgtacacggtgtcacctct

SEQ ID NO: 433805 - DNA, 1099 bp, Homo sapiens
  misc_feature (27)..(27): n is a, c, g, or t
cagtgtagtcgactgggaaaacctggnaaaccaaccaaacaagcaagcaagcaagcaagcaaccaaccaaccaaccaagtaaccgatcaaaccaacccttggagccctttctaaaactttgacctacaaccctgaatccagaatctctgtttagtgggccaacattaataaatttagcctactccaactttgtgttacttccaccatggtgccacacacttaatatccattcccacatatattctccagatttctttctgtataaattgtgtgtgtgtgtgtgtgtgtgtgtgtgtagaaagagagcatcaactgaaaaatcacacaattttataaatttagaaaagagagctttatttcttataaaggtttgcagcctgcaaggtggccattatgacaggctgggaagtgtggcctacagccaaggctagaggcaggcccttccagggagggaaggagaggacaggaatttgagctgaatgagttgactacatatacatactcaataggatatcagaggagctatatcattttatgagaatactcataaaagaggtcctaacacatgcatattgaataaacatgcatgttcattctggtgtggagacttgacatttaaatgtgttataattaggccctacacatcaaaaagtgaagcagggaatgaaggtactcagcctctgtaaaggcacagcctctaaaactggccagaaccagtccatggaggatggtctcttatcaggagaaagttactgaaatcagtcccttgtccagtgaaagctgtcgttaaggtcggtggggcaggagatcagttactcagtgtctgtgaactgggtgagttgtaattgttttaatcttgcttctctcatagccagtgcttgcttggctgctagagaaaaataaaaactatgtggtagttagaatctagtttattctttaagagtagggtacaagacttaacccttgcctggcatggccctaggtcctgtttataatttggggtcttattgccacaaagagtctgttctgtcagtctcatgatctctattttaacgttaatgctgttcagttgattggtgacgtacacggtgtcacctct

SEQ ID NO: 433806 - DNA, 1897 bp, Homo sapiens
tggttcgggagcacccaagtgaaaggggaagagtgcgacaggcggccctggggtcttcacgccaggcgggcggggtccagccagtatgcagtcgggctggacaggggtctcggtgggacagccttcggggacagcgccatccttgtcgtgccaagcggttacatagctgtctggaaatacgtcctcagctgccccagatcccggaagaaaatctctcccacaccactgtagtcagagaggccagtgggtgcatggaactcctcgcacgcgctgtcagcagcagcagtgaggaagccggcagcacagtctgggaaggaaggaggtgcttggctctctcccgggccgccaccttcgccgtcctcgccatcggtctcatcgtcagtttcctcgtcatcgttgtcacctcggtcgtcaggggccgcggacagtgaggggtaggcaccaagcccctcggctttggcaggtgtcgggggcgcaggcagctgcaaactcgcgggccggcgctgcttaccgctgtgcgcggcaccggggtgccccgggggtgcgcagccagcaggtggcgcaggcggtgacgcagctgctcaggtgcgagtggcgggggcacaggggtgggcaggggcgcgggtgcagaggtgctcgcgggtgcagaggagcgcgtgcgataatctgcgtgcattcgtcgataactgtctatgcgaagcaccgacgcagccatgagtacctgcggggcttcactctgtgccacaacgagcgaaccgctgtacaggagctcgactagctgtcgcaccgtctgcacaggcaccaccgaaggcacacggatctcagaggggccgagcagcagcttgtcttggaaggagggcgagccgattgccagcccgcagcggtgcgcacgcagcgaagcttcatgaatgcacacagtcacgtcgcagaagtgcccacccagcttctgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactactacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatgccaaccaaccaagtaacaaaacaaataagcaaacagccaaccaatcaaccaacaagcaagcaagcaacaaaccaaccaaacaagcaagcaagcaagcaagcaaccaaccaaccaaccaagtaaccgatcaaaccaacccttggagccctttctaaaactttgacctacaaccctgaatcagttactcagtgtctgtgaactgggtgagttgtaattgttttaatcttgcttctctcatagccagtgcttgcttggctgctagagaaaaataaaaactatgtggtagttagaatctagtttattctttaagagtagggtacaagacttaacccttgcctggcatggccctaggtcctgtttataatttggggtcttattgccacaaagagtctgttctgtcagtctcatgatctctattttaacgttaatgctgttcagttgattggtgacgtacacggtgtcacctct

SEQ ID NO: 433807 - DNA, 1985 bp, Homo sapiens
tggttcgggagcacccaagtgaaaggggaagagtgcgacaggcggccctggggtcttcacgccaggcgggcggggtccagccagtatgcagtcgggctggacaggggtctcggtgggacagccttcggggacagcgccatccttgtcgtgccaagcggttacatagctgtctggaaatacgtcctcagctgccccagatcccggaagaaaatctctcccacaccactgtagtcagagaggccagtgggtgcatggaactcctcgcacgcgctgtcagcagcagcagtgaggaagccggcagcacagtctgggaaggaaggaggtgcttggctctctcccgggccgccaccttcgccgtcctcgccatcggtctcatcgtcagtttcctcgtcatcgttgtcacctcggtcgtcaggggccgcggacagtgaggggtaggcaccaagcccctcggctttggcaggtgtcgggggcgcaggcagctgcaaactcgcgggccggcgctgcttaccgctgtgcgcggcaccggggtgccccgggggtgcgcagccagcaggtggcgcaggcggtgacgcagctgctcaggtgcgagtggcgggggcacaggggtgggcaggggcgcgggtgcagaggtgctcgcgggtgcagaggagcgcgtgcgataatctgcgtgcattcgtcgataactgtctatgcgaagcaccgacgcagccatgagtacctgcggggcttcactctgtgccacaacgagcgaaccgctgtacaggagctcgactagctgtcgcaccgtctgcacaggcaccaccgaaggcacacggatctcagaggggccgagcagcagcttgtcttggaaggagggcgagccgattgccagcccgcagcggtgcgcacgcagcgaagcttcatgaatgcacacagtcacgtcgcagaagtgcccacccagcttctgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactactacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatggtatgtatcagtagcttgttactttttatgtttgacttctattctgttacttacctacaccgtattttatctatctcttctgcagtttatgggatttaggtcgtttccacgttttggctgttctaaataatgctgctctgagcgttcacatacaagcttttcacatgatttcatttctccagatctaggagtgcaattgctatattatatggcaaccccgtgtttcactttttgacaaagtgccagactgcttttcaaaggacagcatcattttatattcctgccagcaatgtcgaggggtccagtttccacacattctcacaaacacttattgttatctgtctctctagttattgccttcctgatggatgtggagtgctttctcattggttttgatttgcattgtttaaatgagttataagattgagcatgttttcatgtttattggctgcttgtatatcttctttggagaaatgtctattcagattgtctccccattttaaaatcgtgttattttcttttttactattgacttgtgaatgttcaaacatgtata

SEQ ID NO: 433808 - DNA, 672 bp, Homo sapiens
tggataccatggactacacaatgccatgggtttctgtgagtcaaaccattctgactgctgctttgacactgctttccactgtagtgaccacacccacctcatctttggtgattaaggacagcccatgttccctgccaccccaggattcaattatcctcattttatttaaagatcccagtccagtggctgcagtttctgctgtaacattttgcctactgagagcacgagctcaaagctcttccaggatactgggctcctctcacaatattctttctcatgatcgttgtgagaagtatgttctgtagaccctccagtgtgagtgagcaggtctgacataataaatccagtctccctgagtttttgcataccttcctatacacataaaccaaggaagttgtgacatctcaactttatgtactttaggtaaactctgattctgtttcagccaaccaaccaagtaacaaaacaaataagcaaacagccaaccaatcaaccaacaagcaagcaagcaacaaaccaaccaaacaagcaagcaagcaagcaagcaaccaaccaaccaaccaagtaaccgatcaaaccaacccttggagccctttctaaaactttgacctacaaccctgaatccagaatctctgtttagtgggccaacattaataaatttagcctactcca

SEQ ID NO: 433809 - DNA, 1585 bp, Homo sapiens
tggataccatggactacacaatgccatgggtttctgtgagtcaaaccattctgactgctgctttgacactgctttccactgtagtgaccacacccacctcatctttggtgattaaggacagcccatgttccctgccaccccaggattcaattatcctcattttatttaaagatcccagtccagtggctgcagtttctgctgtaacattttgcctactgagagcacgagctcaaagctcttccaggatactgggctcctctcacaatattctttctcatgatcgttgtgagaagtatgttctgtagaccctccagtgtgagtgagcaggtctgacataataaatccagtctccctgagtttttgcataccttcctatacacataaaccaaggaagttgtgacatctcaactttatgtactttaggtaaactctgattctgtttcagccaaccaaccaagtaacaaaacaaataagcaaacagccaaccaatcaaccaacaagcaagcaagcaacaaaccaaccaaacaagcaagcaagcaagcaagcaaccaaccaaccaaccaagtaaccgatcaaaccaacccttggagccctttctaaaactttgacctacaaccctgaatccagaatctctgtttagtgggccaacattaataaatttagcctactccaactttgtgttacttccaccatggtgccacacacttaatatccattcccacatatattctccagatttctttctgtataaattgtgtgtgtgtgtgtgtgtgtgtgtgtgtagaaagagagcatcaactgaaaaatcacacaattttataaatttagaaaagagagctttatttcttataaaggtttgcagcctgcaaggtggccattatgacaggctgggaagtgtggcctacagccaaggctagaggcaggcccttccagggagggaaggagaggacaggaatttgagctgaatgagttgactacatatacatactcaataggatatcagaggagctatatcattttatgagaatactcataaaagaggtcctaacacatgcatattgaataaacatgcatgttcattctggtgtggagacttgacatttaaatgtgttataattaggccctacacatcaaaaagtgaagcagggaatgaaggtactcagcctctgtaaaggcacagcctctaaaactggccagaaccagtccatggaggatggtctcttatcaggagaaagttactgaaatcagtcccttgtccagtgaaagctgtcgttaaggtcggtggggcaggagatcagttactcagtgtctgtgaactgggtgagttgtaattgttttaatcttgcttctctcatagccagtgcttgcttggctgctagagaaaaataaaaactatgtggtagttagaatctagtttattctttaagagtagggtacaagacttaacccttgcctggcatggccctaggtcctgtttataatttggggtcttattgccacaaagagtctgttctgtcagtctcatgatctctattttaacgttaatgctgttcagttgattggtgacgtacacggtgtcacctct

SEQ ID NO: 433810 - DNA, 956 bp, Homo sapiens
agttttctctactaacctatttttctttttcttttttagaccaatgatgcgagctcagagtcaatagcatccttctctaaacaggaggtcatgagtagctttctgccagagggagggtgttacgagctgctcactgtgataggtatgtgcaggggccgtccttactctcctgctttctgctccaggggctgctgcagctttctcagcagccccagatgtgtgtacagcagaggccatccactagttaggaggattcatgggcacagacttgcttctgtgggtcttctctgtttttttatgccaagtatgggaagagatcaaacttccaggaaagaagctcttttgccatctttcctttgtggctgccatgtttccggtgtcctggccatagtgagtcagaaaggttggctgagaaggaactgatgagagaaaaatcaagaaatgtgagccatgaacataacagttaaattctgctgggaaaaggaaaaaaaaaaaagtaacagtagtgaaaaatttaacattaagtttcttttgaaatcaagtcccttttttaaaggaaaattttcttaaaaccttttgttgttcttgtcgttgcgtatggcattccctttttcttttaggcaaaggatttgaggacctgatgactgtgaatctagcaaggtacaaaccaacaggagagtacgtgactgtacggaggattaacctagaagcttgttccaatgagatggtaacattcttgcaggtaataaaccatgagtgtgtcacatggagggagggtgggctcttggctctgataggaattacaaggaattacaaagaaatgaagggagactaaacgttcggaagttatggaagctttcagtggagaatcctggccatttggcactaaggattgggctgaaatgctgctcagcctaatttatatttcccttttcttctccaaacactcccttctg

SEQ ID NO: 433811 - DNA, 968 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagatctcctgttagatgcagtcgactcacggtggatcccagctgtgaggcagcagccttaaggagcgcccatggttgaatgaaggccgctgctggacaagccccggaatgatactccggatgcgggccccccgggcaaaaaacccacaaaccacttcaagacaacccg

SEQ ID NO: 433812 - DNA, 664 bp, Homo sapiens
atgcaacttgttgtgtgccattttacaaactaacagggtcttgtgaataactactgtttcatctctgttttctgtgttatgaattccagtaatagttttcaaattgacatcagtgatccaaggcatctgtaatgtagaacgagtaagatggaaccaatatagggaaggcaaaaacagtcttcattattacagccagtactatctatttctcatctgtcaaatttaagaattattcatcaaataggcaaagaggagtggagaaaggaatcttgtttttagttcaagattctgttaaaaacttttccatagaaatgattcctaactgtactgcatgattctgttttcatagttgggattttgtttgtctgtctaaaggctgatagctaatttgttgcggcttggaagaaatactaattctctttggggttttcctctttagcggtgggtctcggaaaagttcattgttgagggcttaagagatttggaactatttggaggtaagtacagtatggcatttagccatcacttcaggatataaaaatcactacttttttgttgactaaatcaatctatagcaattggcaattctaagggcaagtgtaacctacagttgttggatttctttggttcctttttgaatttatggtttcccaaagatttgaag

SEQ ID NO: 433813 - DNA, 526 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcagggtgagtgtttttctattcttctggctttactatttttgttttctgaaaagcagtgtattttggcagatgttgtaggtggttttctacgtgagggtcggaatgatacggaagtgagggatgtaggaagtaaggcaggtagtgcagcctccactcctgagaagagtttgcagacagaggctgaccagagacacaaaatttaccaccagcttgtctgatagagaagaaataagaagaaagtggcttatttcatgaatatcagtcatacaacattaaatgagtcgatgatacttttaagtgtagacgtttaactgcttatgaccccccgtgagg

SEQ ID NO: 433814 - DNA, 396 bp, Homo sapiens
ctctctgcagcatttttactgtggatctgtgtgtgtttatatgtagccccgcaggcactttttgctgtaatgacttttaagtggtttctattaataaatgtagtcctaagtacaataattgctgttctgaatgtgggtgtgtcttctgctaaaacacaaaatgccaacaatcaatttctctaccccagagcagcctccgggtgacactcggagaaaagtaagtggcttcctaggccctagcactatggctgttgcatggagatgacttcttgtggaagtttgtgtgttttgttggcttatcattttatgtttctgcttatctgtcactgagctttatttgtagtgtgatttttgtacttgtggagattcaggtttcaccctggaaaaatttggatg

SEQ ID NO: 433815 - DNA, 2184 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433816 - DNA, 2078 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcacccgcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433817 - DNA, 2102 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433818 - DNA, 2160 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433819 - DNA, 2126 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433820 - DNA, 2041 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433821 - DNA, 1201 bp, Homo sapiens
atgagcccttcgcgctcagtggccaactctggcctgagtgacagcctgaccaccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433822 - DNA, 3625 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaattctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctggagaatggcattgtgtctgcgtcagctcaggggctacaggctgcttcctggtgtgtgtgcttgcagggatggccgtgctgccccaggtgagagctgtcccaccatccaagagcaggcccatgggtgctcactgaagctcagcagtgacctcttacactagatagaccagtttatttgaaaacctgtaacagatctgtctcttaactatctaaaattttaagactatgaattttagcctgtggtcatcaaaccactttggagctaaaaaggtccaaagattgagattgaggcagaggatgctggtggcctttggcaggaaaggaggtagaagggtttgtcttgcaaccggacatgggtgtctccttaccctgggtgctagcacccaaagagcaggaaacctaagaaccagccccgcccatccctgccatgctggctggcgccagcgagtgtgagccagggggtgcaaatctgaggctccctgcagtgcttccagggcacatggcttacccttctcccagtccctcagggggaaggccctcccccagctcaggcacctcaaatgcccctctaacctgaagctgcactgaaccatcaggtgcccttgctttccgtttcctcccaaattttaacagcagtttaaagaagaaaagtaagcctctttgggcagtgagaggctaaggtgaagggaatgacactgaccctgggctaggatggggcctggggcgagtgagtgtcgggggcggcggggagcatttccggccctcctccccctgctttaaacctcaagttcccttcgcctcgccccgccctcccccccccacacacacacaaacacagagtctgtcgcccaggctggcgtgcactggcttcatgttgactcactgtaggctccacctcccgggttcaagcgattcttctgcctcagcctcccgagtagctaggattacaggcacacaccaccacgcctggataatttttgtatttttagtagagacgggatttcaccatgttggccaggctggtcttggacttctgacctcgtgatccacctgtctctgcctcccaaagtgctgggactacaggcgtgagccaccgccgagccaagttccctttttttgtttgtttttgacgctggtcatcagtttcctttgcttctggatgccttctgcaccttgctgttggggcatcctcaatgcccatctgcagctcagcccacaggcccgtcctgggcagggtgccggggcctcaccatgcccaatggcagcaagccctgctcctagtacccccggggcttcccgtttcttgcatcaaacagcccctttggagaatctgatgacaggtgtggaagctttcccgagaggcagccactttagagggtctgacgctccccactagagagtcggcccacagtgcagacaaaacgcagatcttcctctagagagaacagaaggctggagaggagacgcggagccggtccgtggagtccgccagcctgggaaacagctggtcgctggggaagctgcagcctccctgctcccctgccaggcgtcgggcgagagctgttctgttccctgacaagcgcgtgggccgccagtgctattcctgccacagtgtgggaaggcgctgggct

SEQ ID NO: 433823 - DNA, 1990 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaattctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433824 - DNA, 2623 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagggtgctttctccaagggccatcagtgtcttgcctagcttgagggcttaagtccttatgctgtgttagtttcgttgtcagaacaaattaaaattttcagagacgctgctggagaatggcattgtgtctgcgtcagctcaggggctacaggctgcttcctggtgtgtgtgcttgcagggatggccgtgctgccccaggtgagagctgtcccaccatccaagagcaggcccatgggtgctcactgaagctcagcagtgacctcttacactagatagaccagtttatttgaaaacctgtaacagatctgtctcttaactatctaaaattttaagactatgaattttagcctgtggtcatcaaaccactttggagctaaaaaggtccaaagattgagattgaggcagaggatgctggtggcctttggcaggaaaggaggtagaagggtttgtcttgcaaccggacatgggtgtctccttaccctgggtgctagcacccaaagagcaggaaacctaagaaccagccccgcccatccctgccatgctggctggcgccagcgagtgtgagccagggggtgcaaatctgaggctccctgcagtgcttccagggcacatggcttacccttctcccagtccctcagggggaaggccctcccccagctcaggcacctcaaatgcccctctaacctgaagctgcactgaaccatcaggtgcccttgctttccgtttcctcccaaattttaacagcagtttaaagaagaaaagtaagcctctttgggcagtgagaggctaaggtgaagggaatgacactgaccctgggctaggatggggcctggggcgagtgagtgtcgggggcggcggggagcatttccggccctcctccccctgctttaaacctcaagttcccttcgcctcgccccgccctcccccccccacacacacacaaacacagagtctgtcgcccaggctggcgtgcactggcttcatgttgactcactgtaggctccacctcccgggttcaagcgattcttctgcctcagcctcccgagtagctaggattacaggcacacaccaccacgcctggataatttttgtatttttagtagagacgggatttcaccatgttggccaggctggtcttggacttctgacctcgtgatccacctgtctctgcctcccaaagtgctgggactacaggcgtgagccaccgccgagccaagttccctttttttgtttgtttttgacgctggtcatcagtttcctttgcttctggatgccttctgcaccttgctgttggggcatcctcaatgcccatctgcagctcagcccacaggcccgtcctgggcagggtgccggggcctcaccatgcccaatggcagcaagccctgctcctagtacccccggggcttcccgtttcttgcatcaaacagcccctttggagaatctgatgacaggtgtggaagctttcccgagaggcagccactttagagggtctgacgctccccactagagagtcggcccacagtgcagacaaaacgcagatcttcctctagagagaacagaaggctggagaggagacgcggagccggtccgtggagtccgccagcctgggaaacagctggtcgctggggaagctgcagcctccctgctcccctgccaggcgtcgggcgagagctgttctgttccctgacaagcgcgtgggccgccagtgctattcctgccacagtgtgggaaggcgctgggct

SEQ ID NO: 433825 - DNA, 563 bp, Homo sapiens
actgatgctgtagtcgatctagagtatccccttgattgtcatcttggcggcagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433826 - DNA, 2526 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagggtgctttctccaagggccatcagtgtcttgcctagcttgagggcttaagtccttatgctgtgttagtttcgttgtcagaacaaattaaaattttcagagacgctgctggagaatggcattgtgtctgcgtcagctcaggggctacaggctgcttcctggtgtgtgtgcttgcagggatggccgtgctgccccaggtgagagctgtcccaccatccaagagcaggcccatgggtgctcactgaagctcagcagtgacctcttacactagatagaccagtttatttgaaaacctgtaacagatctgtctcttaactatctaaaattttaagactatgaattttagcctgtggtcatcaaaccactttggagctaaaaaggtccaaagattgagattgaggcagaggatgctggtggcctttggcaggaaaggaggtagaagggtttgtcttgcaaccggacatgggtgtctccttaccctgggtgctagcacccaaagagcaggaaacctaagaaccagccccgcccatccctgccatgctggctggcgccagcgagtgtgagccagggggtgcaaatctgaggctccctgcagtgcttccagggcacatggcttacccttctcccagtccctcagggggaaggccctcccccagctcaggcacctcaaatgcccctctaacctgaagctgcactgaaccatcaggtgcccttgctttccgtttcctcccaaattttaacagcagtttaaagaagaaaagtaagcctctttgggcagtgagaggctaaggtgaagggaatgacactgaccctgggctaggatggggcctggggcgagtgagtgtcgggggcggcggggagcatttccggccctcctccccctgctttaaacctcaagttcccttcgcctcgccccgccctcccccccccacacacacacaaacacagagtctgtcgcccaggctggcgtgcactggcttcatgttgactcactgtaggctccacctcccgggttcaagcgattcttctgcctcagcctcccgagtagctaggattacaggcacacaccaccacgcctggataatttttgtatttttagtagagacgggatttcaccatgttggccaggctggtcttggacttctgacctcgtgatccacctgtctctgcctcccaaagtgctgggactacaggcgtgagccaccgccgagccaagttccctttttttgtttgtttttgacgctggtcatcagtttcctttgcttctggatgccttctgcaccttgctgttggggcatcctcaatgcccatctgcagctcagcccacaggcccgtcctgggcagggtgccggggcctcaccatgcccaatggcagcaagccctgctcctagtacccccggggcttcccgtttcttgcatcaaacagcccctttggagaatctgatgacaggtgtggaagctttcccgagaggcagccactttagagggtctgacgctccccactagagagtcggcccacagtgcagacaaaacgcagatcttcctctagagagaacagaaggctggagaggagacgcggagccggtccgtggagtccgccagcctgggaaacagctggtcgctggggaagctgcagcctccctgctcccctgccaggcgtcgggcgagagctgttctgttccctgacaagcgcgtgggccgccagtgctattcctgccacagtgtgggaaggcgctgggct

SEQ ID NO: 433827 - DNA, 2565 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagggtgctttctccaagggccatcagtgtcttgcctagcttgagggcttaagtccttatgctgtgttagtttcgttgtcagaacaaattaaaattttcagagacgctgctggagaatggcattgtgtctgcgtcagctcaggggctacaggctgcttcctggtgtgtgtgcttgcagggatggccgtgctgccccaggtgagagctgtcccaccatccaagagcaggcccatgggtgctcactgaagctcagcagtgacctcttacactagatagaccagtttatttgaaaacctgtaacagatctgtctcttaactatctaaaattttaagactatgaattttagcctgtggtcatcaaaccactttggagctaaaaaggtccaaagattgagattgaggcagaggatgctggtggcctttggcaggaaaggaggtagaagggtttgtcttgcaaccggacatgggtgtctccttaccctgggtgctagcacccaaagagcaggaaacctaagaaccagccccgcccatccctgccatgctggctggcgccagcgagtgtgagccagggggtgcaaatctgaggctccctgcagtgcttccagggcacatggcttacccttctcccagtccctcagggggaaggccctcccccagctcaggcacctcaaatgcccctctaacctgaagctgcactgaaccatcaggtgcccttgctttccgtttcctcccaaattttaacagcagtttaaagaagaaaagtaagcctctttgggcagtgagaggctaaggtgaagggaatgacactgaccctgggctaggatggggcctggggcgagtgagtgtcgggggcggcggggagcatttccggccctcctccccctgctttaaacctcaagttcccttcgcctcgccccgccctcccccccccacacacacacaaacacagagtctgtcgcccaggctggcgtgcactggcttcatgttgactcactgtaggctccacctcccgggttcaagcgattcttctgcctcagcctcccgagtagctaggattacaggcacacaccaccacgcctggataatttttgtatttttagtagagacgggatttcaccatgttggccaggctggtcttggacttctgacctcgtgatccacctgtctctgcctcccaaagtgctgggactacaggcgtgagccaccgccgagccaagttccctttttttgtttgtttttgacgctggtcatcagtttcctttgcttctggatgccttctgcaccttgctgttggggcatcctcaatgcccatctgcagctcagcccacaggcccgtcctgggcagggtgccggggcctcaccatgcccaatggcagcaagccctgctcctagtacccccggggcttcccgtttcttgcatcaaacagcccctttggagaatctgatgacaggtgtggaagctttcccgagaggcagccactttagagggtctgacgctccccactagagagtcggcccacagtgcagacaaaacgcagatcttcctctagagagaacagaaggctggagaggagacgcggagccggtccgtggagtccgccagcctgggaaacagctggtcgctggggaagctgcagcctccctgctcccctgccaggcgtcgggcgagagctgttctgttccctgacaagcgcgtgggccgccagtgctattcctgccacagtgtgggaaggcgctgggct

SEQ ID NO: 433828 - DNA, 2171 bp, Homo sapiens
ccaccatatactctccgggccatgaaccctaacccatactacccatccatactcatcattaataatcataatggctatagccataaaactaggaatagccccctttcacttctgagtcccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctggagaatggcattgtgtctgcgtcagctcaggggctacaggctgcttcctggtgtgtgtgcttgcagggatggccgtgctgccccaggtgagagctgtcccaccatccaagagcaggcccatgggtgctcactgaagctcagcagtgacctcttacactagatagaccagtttatttgaaaacctgtaacagatctgtctcttaactatctaaaattttaagactatgaattttagcctgtggtcatcaaaccactttggagctaaaaaggtccaaagattgagattgaggcagaggatgctggtggcctttggcaggaaaggaggtagaagggtttgtcttgcaaccggacatgggtgtctccttaccctgggtgctagcacccaaagagcaggaaacctaagaaccagccccgcccatccctgccatgctggctggcgccagcgagtgtgagccagggggtgcaaatctgaggctccctgcagtgcttccagggcacatggcttacccttctcccagtccctcagggggaaggccctcccccagctcaggcacctcaaatgcccctctaacctgaagctgcactgaaccatcaggtgcccttgctttccgtttcctcccaaattttaacagcagtttaaagaagaaaagtaagcctctttgggcagtgagaggctaaggtgaagggaatgacactgaccctgggctaggatggggcctggggcgagtgagtgtcgggggcggcggggagcatttccggccctcctccccctgctttaaacctcaagttcccttcgcctcgccccgccctcccccccccacacacacacaaacacagagtctgtcgcccaggctggcgtgcactggcttcatgttgactcactgtaggctccacctcccgggttcaagcgattcttctgcctcagcctcccgagtagctaggattacaggcacacaccaccacgcctggataatttttgtatttttagtagagacgggatttcaccatgttggccaggctggtcttggacttctgacctcgtgatccacctgtctctgcctcccaaagtgctgggactacaggcgtgagccaccgccgagccaagttccctttttttgtttgtttttgacgctggtcatcagtttcctttgcttctggatgccttctgcaccttgctgttggggcatcctcaatgcccatctgcagctcagcccacaggcccgtcctgggcagggtgccggggcctcaccatgcccaatggcagcaagccctgctcctagtacccccggggcttcccgtttcttgcatcaaacagcccctttggagaatctgatgacaggtgtggaagctttcccgagaggcagccactttagagggtctgacgctccccactagagagtcggcccacagtgcagacaaaacgcagatcttcctctagagagaacagaaggctggagaggagacgcggagccggtccgtggagtccgccagcctgggaaacagctggtcgctggggaagctgcagcctccctgctcccctgccaggcgtcgggcgagagctgttctgttccctgacaagcgcgtgggccgccagtgctattcctgccacagtgtgggaaggcgctgggct

SEQ ID NO: 433829 - DNA, 846 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggtgcgttcttaggcggcctttcccatgattacagtgggtagctatgcccctgagccttcaggtaaagtgaagtttgactgaagttaatgaagccagagtttaaaatcaaggatctggattcttgctgaagatct

SEQ ID NO: 433830 - DNA, 2213 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433831 - DNA, 3848 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctggagaatggcattgtgtctgcgtcagctcaggggctacaggctgcttcctggtgtgtgtgcttgcagggatggccgtgctgccccaggtgagagctgtcccaccatccaagagcaggcccatgggtgctcactgaagctcagcagtgacctcttacactagatagaccagtttatttgaaaacctgtaacagatctgtctcttaactatctaaaattttaagactatgaattttagcctgtggtcatcaaaccactttggagctaaaaaggtccaaagattgagattgaggcagaggatgctggtggcctttggcaggaaaggaggtagaagggtttgtcttgcaaccggacatgggtgtctccttaccctgggtgctagcacccaaagagcaggaaacctaagaaccagccccgcccatccctgccatgctggctggcgccagcgagtgtgagccagggggtgcaaatctgaggctccctgcagtgcttccagggcacatggcttacccttctcccagtccctcagggggaaggccctcccccagctcaggcacctcaaatgcccctctaacctgaagctgcactgaaccatcaggtgcccttgctttccgtttcctcccaaattttaacagcagtttaaagaagaaaagtaagcctctttgggcagtgagaggctaaggtgaagggaatgacactgaccctgggctaggatggggcctggggcgagtgagtgtcgggggcggcggggagcatttccggccctcctccccctgctttaaacctcaagttcccttcgcctcgccccgccctcccccccccacacacacacaaacacagagtctgtcgcccaggctggcgtgcactggcttcatgttgactcactgtaggctccacctcccgggttcaagcgattcttctgcctcagcctcccgagtagctaggattacaggcacacaccaccacgcctggataatttttgtatttttagtagagacgggatttcaccatgttggccaggctggtcttggacttctgacctcgtgatccacctgtctctgcctcccaaagtgctgggactacaggcgtgagccaccgccgagccaagttccctttttttgtttgtttttgacgctggtcatcagtttcctttgcttctggatgccttctgcaccttgctgttggggcatcctcaatgcccatctgcagctcagcccacaggcccgtcctgggcagggtgccggggcctcaccatgcccaatggcagcaagccctgctcctagtacccccggggcttcccgtttcttgcatcaaacagcccctttggagaatctgatgacaggtgtggaagctttcccgagaggcagccactttagagggtctgacgctccccactagagagtcggcccacagtgcagacaaaacgcagatcttcctctagagagaacagaaggctggagaggagacgcggagccggtccgtggagtccgccagcctgggaaacagctggtcgctggggaagctgcagcctccctgctcccctgccaggcgtcgggcgagagctgttctgttccctgacaagcgcgtgggccgccagtgctattcctgccacagtgtgggaaggcgctgggct

SEQ ID NO: 433832 - DNA, 2437 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433833 - DNA, 2447 bp, Homo sapiens
agttttctctactaacctatttttctttttcttttttagaccaatgatgcgagctcagagtcaatagcatccttctctaaacaggaggtcatgagtagctttctgccagagggagggtgttacgagctgctcactgtgataggtatgtgcaggggccgtccttactctcctgctttctgctccaggggctgctgcagctttctcagcagccccagatgtgtgtacagcagaggccatccactagttaggaggattcatgggcacagacttgcttctgtgggtcttctctgtttttttatgccaagtatgggaagagatcaaacttccaggaaagaagctcttttgccatctttcctttgtggctgccatgtttccggtgtcctggccatagtgagtcagaaaggttggctgagaaggaactgatgagagaaaaatcaagaaatgtgagccatgaacataacagttaaattctgctgggaaaaggaaaaaaaaaaaagtaacagtagtgaaaaatttaacattaagtttcttttgaaatcaagtcccttttttaaaggaaaattttcttaaaaccttttgttgttcttgtcgttgcgtatggcattccctttttcttttaggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433834 - DNA, 2012 bp, Homo sapiens
ctgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggtctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 433835 - DNA, 226 bp, Homo sapiens
tgtgtcttctgcaaagtgttttccccaaatctacacataattcttatgctccaagaataacaagaacaagaaaatgctgtctctaacagtgtcctctgtcagctccatatgtctaaatctgacacgttggcatgagccccactccatacccctgctcaagtcactgagattatgcctagtaaagtgaaaatctgttcccgtatttgccatctatagtaaataggct

SEQ ID NO: 433836 - DNA, 717 bp, Homo sapiens
tctgtagcccaagcttgagtgcagtcgtgtgatcctggctcactgcaacctccgccccctgggctcaagggattctcatgcttcagcctcctgaatagctggaattataggtgcccgccacaacgcctggctaagtttttgtattttactagagacggggtttcaccatgttgcccaaggtggtcttgaactcctgagctcaggcgatgtgcccgccttggcctcccaaagtgctgggattacaggcatcagccactgcacccggcctgaaaacacattttcttaatgggactaaacttttctagctgaattgatctattttaaaacttgccaatgaaagctccttagtagtatctgctaattaaatgcagtttttatacctaacggaccttttaaagaatgtgtgcactttgcaaaccccattgcttcttgccgtatctgagcacttgccacctggtggtaaggagaccattccatctccttcactagatggtagcacctggaagtcagggatcattgctgacttatcttgcctcccaacattgatcatgcagtaggtgtggatgagaaagagggagataagggaagaaagggggctgtgaataaacgctgttgctttctgcttcctttttagggagttaaaagtctcttcagctacctgtttagggagtatgaaagcaaatctagggaaatggccctctgccagttttcccgaat

SEQ ID NO: 433837 - DNA, 1233 bp, Homo sapiens
gagtttgcctaagaaagtacagcacctaatgtttgaggtaattaataattctgttaattggcgaagagaaggatagtctcagttttgatgtataacatcctatccacaaatacttgtaagtagtttaaacctttgtctcagaaattaagtgggtttaaacaaatcttagcctggccaggcgctgtggctcatgcctgtaatcccagcactttgggaggctgaggcaggtgaatcacctgaggttaggagtttgagaccagcctggccaacgtggtgaaaccctgtctctactaaaaatacaaaaaattacccgggcgtggtgccgggcacctgtaatcccagctactcaggaggctgaggcaggagaacagcttaaactgggaaggtggaggttgcagtgagccaagattgcgtcattgcactccagcctgggcaacaagagtgaaactccatctcaaaaaaaaaaaaaaaaagaaaaaagaaaaaaaaaaccttagcctttgaatagttggacaaatatttattttatctccatctccaggccctttttttattttttattttttggttgggcctaaaacccgtttatatttctccctagtgttgtaggttcattttgttggcctgtgatgggctcttcaaggtctttaccccagaagaagccgtgaacttcatcttgtcctgtctcgaggtgagaaatctcacacgggggtggtggttgtcccaattgtgtcttagttttcagagaagtagaagttctgagaccccatttcctcccattgtgggacagcccttgtgccctttttcagtgtgaactctgcctactgactcactggtcagtttgtcctgccagccctgatggagaccagagcagctcttcttcctggcagtcatgtctcaggaaagtgacagggtgcggggtcactccattcactcattccctttctcatctggtaggagatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433838 - DNA, 1467 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433839 - DNA, 1545 bp, Homo sapiens
  misc_feature (1510)..(1511): n is a, c, g, or t
  misc_feature (1514)..(1514): n is a, c, g, or t
  misc_feature (1525)..(1525): n is a, c, g, or t
  misc_feature (1534)..(1534): n is a, c, g, or t
  misc_feature (1537)..(1537): n is a, c, g, or t
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttcctaaaaaaaaaaaaaaaaagaaaaaaaaaaaaaaaaaaaaaaaaannaanacaaaaaaaanaagaagaanaanagaaaaaa

SEQ ID NO: 433840 - DNA, 328 bp, Homo sapiens
ggtggcgtccgggactctccctgcaggtgactgacggcgccggccgcccctgcccgtcgcccgcccgctgctgccgcccgcccggggtgtggagcccggccgtacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433841 - DNA, 815 bp, Homo sapiens
agagcttgcagctgcctaaggtgacagtgctgcagcctagaccagaattgttctttggggcagtaggcttccccaaatggtttttccttggcaataggactgtcccttagatgtctcttcccatttgtagatcactgccctatctcctccatatcccctcacctaaaatagaatgggtgaaactatgatgctatgcaggatactgtcatttacattaacattaaaccgtacctgtacttgatgcaaaggacatgtgctccacaatccaggaatagccactttcagggattttccaaatctaattagattgaaatgcaaaatatccctctgttctagctattgttaaccctggctgcatgtgggaaacactcaaggagctttaagatacaaaacactgccaggctcccttacccagtcagtcaaatccgattctggagttgggacctaggtgtgtgatgagaactgctgagtcctgtcgaaggttaagctgggcagcactgcttggcagccactggaggtgctgttcccacccatgtgcagctgggcagggtccctaccccagggcagcagttaatggccaaagaaacaggcccttgaaggtaatgtggagtgggtagcctccgtattgattaagaaggggacggacttaccctccactgtgagagttacccgaagctcagcatccgtgatggtctagggggcttctgaggcgatcgggcagcgtgagtcttcagccactaagccaagaagatctgggaaggagtcagtgagacagccttgggccagagttccaggggctctgggagtggctgcca

SEQ ID NO: 433842 - DNA, 1490 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggtacagtcttcaggctctcccaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433843 - DNA, 1720 bp, Homo sapiens
cagaggtatgtgaaaaaacccacttgtagctttgctgggaagatgtcatcttcaacttagcttgtcacttcccagaagacagctcttcacagtgttcattttattatttgtctggcattaggtatcagaaaataagcttaaatgagtctaaccattaaatgtaaatagatctctgcctgcattggaatcttttatccttttcttcctcagttgaagtaaaagcagctgatcttactgtttgttcaaattcttcaccagccttgagcatggaaatacatattttcagggcatcttaagggcttttgagataaactctcctgacttgcatttgtccttattcaattatcacaagactaatttgcacatgatccttttgcctgatttgaatctcacttctctgggatggcagcacatcccttgccctgatgctttgacttacaccctagacagagttgttttgtgctcactgactcctcttttgtgtccctgtgcaacctcttagagctcaccctgtccaacagtgctccgatttgagttatagacttgcagctgggggagatgccttaaggggtattgcttatttgtttgcgccattaggatattgctgagtcagacagtcatagttccctctcatttgctctgggactagggtttccagagggttgggcacagttttgtattggctcttttgttctcttttccttagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433844 - DNA, 1591 bp, Homo sapiens
  misc_feature (1469)..(1469): n is a, c, g, or t
  misc_feature (1556)..(1557): n is a, c, g, or t
  misc_feature (1560)..(1560): n is a, c, g, or t
  misc_feature (1571)..(1571): n is a, c, g, or t
  misc_feature (1580)..(1580): n is a, c, g, or t
  misc_feature (1583)..(1583): n is a, c, g, or t
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttcctaanaaaaaaagaaaaacaaacaacaacaaaaacaaacaaagaaaaacaaaaaaaaaaaaaaaagaaaaaaaaaaaaaaaaaaaaaaaaannaanacaaaaaaaanaagaagaanaanagaaaaaa

SEQ ID NO: 433845 - DNA, 1531 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttcctaagaaacctttatttacaaccattggagtcccggggaatctctaaaattgaactggagggcttca

SEQ ID NO: 433846 - DNA, 1735 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggtgagaaatctcacacgggggtggtggttgtcccaattgtgtcttagttttcagagaagtagaagttctgagaccccatttcctcccattgtgggacagcccttgtgccctttttcagtgtgaactctgcctactgactcactggtcagtttgtcctgccagccctgatggagaccagagcagctcttcttcctggcagtcatgtctcaggaaagtgacagggtgcggggtcactccattcactcattccctttctcatctggtaggagatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433847 - DNA, 1347 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433848 - DNA, 1425 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcaggtaaccaagggactgagaggagctcatgggaaggagggctgttagctgtagaagggtcccgagaccttcaaggagtagaacttcccctgttacgtagtcttcagtgtgacgaggctctgtctgagatctaacactggtgacataggtggatgacagttgtagatttcacatgtgtccacgtggaaggaaacttgcctccctacatttgcaaaaggacaaattcatatttaccattcacagtgttttctctgtgcctaggaagtttcttaaatactgtcacttttcgtggtggcgggcgcctgtagtcccagctactcgggaggctgaggcaggagaatggcgtgaacctgggaggcggagcttgcagtgagccaagatcgcaccactgcactccagcctgggcaacagagcgagactccatctcaaaaaaaaaa

SEQ ID NO: 433849 - DNA, 1226 bp, Homo sapiens
agagcttgcagctgcctaaggtgacagtgctgcagcctagaccagaattgttctttggggcagtaggcttccccaaatggtttttccttggcaataggactgtcccttagatgtctcttcccatttgtagatcactgccctatctcctccatatcccctcacctaaaatagaatgggtgaaactatgatgctatgcaggatactgtcatttacattaacattaaaccgtacctgtacttgatgcaaaggacatgtgctccacaatccaggaatagccactttcagggattttccaaatctaattagattgaaatgcaaaatatccctctgttctagctattgttaaccctggctgcatgtgggaaacactcaaggagctttaagatacaaaacactgccaggctcccttacccagtcagtcaaatccgattctggagttgggacctaggtgtgtgatgagaactgctgagtcctgtcgaaggttaagctgggcagcactgcttggcagccactggaggtgctgttcccacccatgtgcagctgggcagggtccctaccccagggcagcagttaatggcctagacacccctggcatatttgagatcaagaaatgtcagtagtggttaataatgtgaattccacagtctgtatctttcacacttccattctctgcttttaaggtgagattctaagtactgtggacccataatctgtcaggtagagtctgaaatgtttttcctctcattttagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433850 - DNA, 1353 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggtatgtggctctggagccacccacttagatgacaatacgttttatggggaaaagactttagcacgtacttgttgaataagattaaagtgatggtgtctggttgaaacctttcttctggggttgctgcagagtgttctgctgcagtttaacttctgggtaagggaacagcaactcagctagaggctgtttgttctctggggaacttacgccctatgatagacttgtgctttaaaacccagatcccgtcttttttgtttcttttttcctcccgtggtttgtgtgtgtgatgctgtggatcagaatgtaatcagtatgcaagtagcctaaatcttcttttatttcctttctctgaccttagacagtaatgaatgaaaagctttaacccctgcctatcaaagttactgtgatttcagagtaacttgagagctgtagctagaaaataccagatgaggtgccattcatcacccgagcccggtccctggct

SEQ ID NO: 433851 - DNA, 965 bp, Homo sapiens
gagtttgcctaagaaagtacagcacctaatgtttgaggtaattaataattctgttaattggcgaagagaaggatagtctcagttttgatgtataacatcctatccacaaatacttgtaagtagtttaaacctttgtctcagaaattaagtgggtttaaacaaatcttagcctggccaggcgctgtggctcatgcctgtaatcccagcactttgggaggctgaggcaggtgaatcacctgaggttaggagtttgagaccagcctggccaacgtggtgaaaccctgtctctactaaaaatacaaaaaattacccgggcgtggtgccgggcacctgtaatcccagctactcaggaggctgaggcaggagaacagcttaaactgggaaggtggaggttgcagtgagccaagattgcgtcattgcactccagcctgggcaacaagagtgaaactccatctcaaaaaaaaaaaaaaaaagaaaaaagaaaaaaaaaaccttagcctttgaatagttggacaaatatttattttatctccatctccaggccctttttttattttttattttttggttgggcctaaaacccgtttatatttctccctagtgttgtaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttccta

SEQ ID NO: 433852 - DNA, 1350 bp, Homo sapiens
  misc_feature (1228)..(1228): n is a, c, g, or t
  misc_feature (1315)..(1316): n is a, c, g, or t
  misc_feature (1319)..(1319): n is a, c, g, or t
  misc_feature (1330)..(1330): n is a, c, g, or t
  misc_feature (1339)..(1339): n is a, c, g, or t
  misc_feature (1342)..(1342): n is a, c, g, or t
agagcttgcagctgcctaaggtgacagtgctgcagcctagaccagaattgttctttggggcagtaggcttccccaaatggtttttccttggcaataggactgtcccttagatgtctcttcccatttgtagatcactgccctatctcctccatatcccctcacctaaaatagaatgggtgaaactatgatgctatgcaggatactgtcatttacattaacattaaaccgtacctgtacttgatgcaaaggacatgtgctccacaatccaggaatagccactttcagggattttccaaatctaattagattgaaatgcaaaatatccctctgttctagctattgttaaccctggctgcatgtgggaaacactcaaggagctttaagatacaaaacactgccaggctcccttacccagtcagtcaaatccgattctggagttgggacctaggtgtgtgatgagaactgctgagtcctgtcgaaggttaagctgggcagcactgcttggcagccactggaggtgctgttcccacccatgtgcagctgggcagggtccctaccccagggcagcagttaatggcctagacacccctggcatatttgagatcaagaaatgtcagtagtggttaataatgtgaattccacagtctgtatctttcacacttccattctctgcttttaaggtgagattctaagtactgtggacccataatctgtcaggtagagtctgaaatgtttttcctctcattttagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttttcctaanaaaaaaagaaaaacaaacaacaacaaaaacaaacaaagaaaaacaaaaaaaaaaaaaaaagaaaaaaaaaaaaaaaaaaaaaaaaannaanacaaaaaaaanaagaagaanaanagaaaaaa

SEQ ID NO: 433853 - DNA, 476 bp, Homo sapiens
tcatcctgggattgtagttgtctcaatctttttccctttcccccattttcaacacacagatgttttaggtgttggactgtctttaagttttgaatccatggcatcaggtaaggcagaaaaatctgctagtcgctagccctgagaagtactgcgaggaaatgtggagcagttttctctggttcatttgagtatttattttactacctgaagtacaatttaactttttaaggcagatttttatttcctttgaaataataggactttaaaataggttcaagatattattcattgcagtatgagttgccactggattgacgcaaagttttgagtttatttcagtaacctacataggtgtcctggtgggatggattctgaaacttaagtcttacatattttttgtgggctcactaagtgttctgctgtgtttcaggatcagggggacctttgctttttgatgatctcccacccgctagcag

SEQ ID NO: 433854 - DNA, 501 bp, Homo sapiens
attcgagcctcaaaatttgctgcacagaatttgcatcaaaacttaatcagaaaatttcctaaaggtgagactgagaactaaatcagttgatactcaaattggttattgctgtttggttggctgtgtgaagcagtcagatgtgttattttggctttagcagagaatcattgatgagtcttaaaagagtggtgctgaggagtggatgccaaggcttccaggagtagcggccatgcaggtgtgacttagaatggcacttctcatgattctaagtgataggcaccttttgtcaatcgtctttgggttcagttagtgtcttgcctttactggaaaactagtaaaccaacttcaaatagcactgtgttatatgtgaggaaagaaacagagattgttctggctgggcacggtggctcacacagcactttgggaggccaaggccagaagatcactcaagcccaggagtttgagaccagcctggcaacatagggagactctatctctata

SEQ ID NO: 433855 - DNA, 1669 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433856 - DNA, 2050 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctgaaaaaaaaaaaaaagaaaaaaaaaaaaattgggggccgcctgggcccgaaaaagttttaaaaccatcgtggggcgccgggcccaggtagggacctgggcccaagggcccaagaaacccggcgcgaccgggcgggttctcccccataaaaaaccgccggcggcacggcgtctgacaacccagaggggtccggggggcacgcgggctacccagggcgcagggaccgaaatacgagcgacgggggaggagcgaaccatcacaacaaacaaggatccagcacatgtgaagagcgcagcaaaacaacaccagaccgaacaaacaccaacaccaagagaaccaacagagacacaaagacaagaacgatcaaagaaactgacacacagc

SEQ ID NO: 433857 - DNA, 2356 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggtaggtttgtggtgagggaggacgggccgcgcgggccggccgagcctccgggaggtcaccgagcgcagctttaatacctgagctcgaaggccccgctgtgctcgccgacccccgtacctcgcggccgggcccttgggacccacagcatccttgtgaggcccggaggcctgtccagcccgactggacagtgccgaggggcaccgagagccagcttggcaccgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433858 - DNA, 3164 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggtaggtttgtggtgagggaggacgggccgcgcgggccggccgagcctccgggaggtcaccgagcgcagctttaatacctgagctcgaaggccccgctgtgctcgccgacccccgtacctcgcggccgggcccttgggacccacagcatccttgtgaggcccggaggcctgtccagcccgactggacagtgccgaggggcaccgagagccagcttggcaccgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgaggtcctgcctgtgttcgacctggtggggggcactaagagcccctgatagtacccctgaccccatccttattgggtgcacaagacacaggtcactctgggcgggcaaggagttttggtagcaggagaggagtcggtggatggatggctgaggacagtgcagaagggtgtggctgggccgtctttttttgcctggaaattcaagttctgaggcacccagtcactccagcactaaatgggtgcaggaggcagcacttgtctgcccagctggaaaggcagggtatgtgctgagtgttacaggtggaaggccactggaggtcgctccaggagccgcggggatttacctctgcctaacagggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgaggtaacgagtcaaaagtccctaccctgggtcctagcctgtcaggggctccgaaaacccaggctcaggtcggtcctgcccggcacctgtttcacacatgtacactccggtctgaggttggtcctctcccccaccccacccacctgcagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433859 - DNA, 1978 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433860 - DNA, 1485 bp, Homo sapiens
  misc_feature (53)..(54): n is a, c, g, or t
aaacaggctggtaccggccgggatttaggatcaagatggagactgccgagcgnnttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433861 - DNA, 1813 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgggctgctcaaggtgatggtcgacaccccactttcctgagagcttgaccctcagatgccagggccttggctgcagattccttgggagctcccggggatcttccagcaaataggagcaaatcttttccccgtggatcaggaaggtgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433862 - DNA, 1302 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433863 - DNA, 1477 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433864 - DNA, 1757 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggtaggtttgtggtgagggaggacgggccgcgcgggccggccgagcctccgggaggtcaccgagcgcagctttaatacctgagctcgaaggccccgctgtgctcgccgacccccgtacctcgcggccgggcccttgggacccacagcatccttgtgaggcccggaggcctgtccagcccgactggacagtgccgaggggcaccgagagccagcttggcaccgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgaggtcctgcctgtgttcgacctggtggggggcactaagagcccctgatagtacccctgaccccatccttattgggtgcacaagacacaggtcactctgggcgggcaaggagttttggtagcaggagaggagtcggtggatggatggctgaggacagtgcagaagggtgtggctgggccgtctttttttgcctggaaattcaagttctgaggcacccagtcactccagcactaaatgggtgcaggaggcagcacttgtctgcccagctggaaaggcagggtatgtgctgagtgttacaggtggaaggccactggaggtcgctccaggagccgcggggatttacctctgcctaacagggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433865 - DNA, 1692 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggtaggtttgtggtgagggaggacgggccgcgcgggccggccgagcctccgggaggtcaccgagcgcagctttaatacctgagctcgaaggccccgctgtgctcgccgacccccgtacctcgcggccgggcccttgggacccacagcatccttgtgaggcccggaggcctgtccagcccgactggacagtgccgaggggcaccgagagccagcttggcaccgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgaggtcctgcctgtgttcgacctggtggggggcactaagagcccctgatagtacccctgaccccatccttattgggtgcacaagacacaggtcactctgggcgggcaaggagttttggtagcaggagaggagtcggtggatggatggctgaggacagtgcagaagggtgtggctgggccgtctttttttgcctggaaattcaagttctgaggcacccagtcactccagcactaaatgggtgcaggaggcagcacttgtctgcccagctggaaaggcagggtatgtgctgagtgttacaggtggaaggccactggaggtcgctccaggagccgcggggatttacctctgcctaacagggctgctcaaggtgatggtcgacaccccactttcctgagagcttgaccctcagatgccagggccttggctgcagattccttgggagctcccggggatcttccagcaaataggagcaaatcttttccccgtggatcaggaaggtggaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 433866 - DNA, 1711 bp, Homo sapiens
gctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggtaggtttgtggtgagggaggacgggccgcgcgggccggccgagcctccgggaggtcaccgagcgcagctttaatacctgagctcgaaggccccgctgtgctcgccgacccccgtacctcgcggccgggcccttgggacccacagcatccttgtgaggcccggaggcctgtccagcccgactggacagtgccgaggggcaccgagagccagcttggcaccgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgaggtcctgcctgtgttcgacctggtggggggcactaagagcccctgatagtacccctgaccccatccttattgggtgcacaagacacaggtcactctgggcgggcaaggagttttggtagcaggagaggagtcggtggatggatggctgaggacagtgcagaagggtgtggctgggccgtctttttttgcctggaaattcaagttctgaggcacccagtcactccagcactaaatgggtgcaggaggcagcacttgtctgcccagctggaaaggcagggtatgtgctgagtgttacaggtggaaggccactggaggtcgctccaggagccgcggggatttacctctgcctaacagggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgaggtaacgagtcaaaagtccctaccctgggtcctagcctgtcaggggctccgaaaacccaggctcagaccggagtgtacatgtgtgaaacaggtgccgggcaggaccggtcgaccggc

SEQ ID NO: 433867 - DNA, 510 bp, Homo sapiens
ttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgagaggagggcttggagggggaggcgggactccaccctgtgtgggacagttctgtcagttgaccctccacttgtccaggggcagtggatctgcagggggaactcattctcaatactgttcctcctgagaaacaaattttctgggctgttttggtttaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctgggga

SEQ ID NO: 433868 - DNA, 259 bp, Homo sapiens
ccaaagccaggctcatgcctgacacagtgtatacactgcagcccccgtgggaaactatgtgccaatagactgcttaaagaactggggcaaatagaaagccgagaaatagcctggcacaacaaggagcccgtgtacagcctggacttccagcatgggacggctgggaggatccacagactggcgtctgccggcgtggacaccaatgtcagggtaaactggggcagagatagacatccgggaacactgcttgaagcaatag

SEQ ID NO: 433869 - DNA, 2279 bp, Homo sapiens
cgggaagcggcgcgcgctgcgcgggaggtgacggtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggta

SEQ ID NO: 433870 - DNA, 2247 bp, Homo sapiens
gttaacactgttgtttaatccatcaccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggta

SEQ ID NO: 433871 - DNA, 2377 bp, Homo sapiens
cgggaagcggcgcgcgctgcgcgggaggtgacggtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttaactctgtctcaaaaaaaaaaaaaaagagaaaaagaagaacagtattaggttttacaaatctgtttcttgtgcattgattgtgggagttggggtgggggacccctgatggcctgcctgttctcagccatcatccttaaatataaatcaaaattggcaataaaagaccaagtgaagtca

SEQ ID NO: 433872 - DNA, 1744 bp, Homo sapiens
  misc_feature (161)..(161): n is a, c, g, or t
gtgaaccgggatatggatcaggagaacgtggttactagcacagagagttctcccagtaggttaatagtggggggtaaggcgaggttagcgaggcttgctagaagtcatcaaaaagctattagtgggagtagagtttgaagtccttgagagaggattatgtngctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggta

SEQ ID NO: 433873 - DNA, 1143 bp, Homo sapiens
cgggaagcggcgcgcgctgcgcgggaggtgacggtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatgttgtatcttttcccgggtttttgccttcaaacaagcttgtgatttttgctcgaacttccctcttctaagtagatgtgagagtgttggtaaggtctgttaacttttc

SEQ ID NO: 433874 - DNA, 1070 bp, Homo sapiens
cgggaagcggcgcgcgctgcgcgggaggtgacggtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagacacagtctcactctgtcacccaggcaggtgttgtggcgcaatctcacaatctcagctcactgcaacctctgcctcctggtttcaagcgattctcctgtctcagcttccctattagctgggattacaggcacatgccaccatgcccggttaatttttgtgtttttagtagagacagggtttcaccacgttggtcaagctgttctcaaactcctaacctcaaatgatctgcctgccttggccaatgtgctgggattacaggcatgagccaccatgccccgccctgaacttagtaaatctttattattattactatttttttttttttttgagagaggggcttactctgtcaccca

SEQ ID NO: 433875 - DNA, 301 bp, Homo sapiens
  misc_feature (11)..(11): n is a, c, g, or t
tgacataaganaaataatcagtttgaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433876 - DNA, 2949 bp, Homo sapiens
ggcggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcaaggatggtgtttcgggtggcgggatggggagcagcttggtccatgtgccttcagggggttgttacctgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433877 - DNA, 2555 bp, Homo sapiens
ggcggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctggtgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcaaggatggtgtttcgggtggcgggatggggagcagcttggtccatgtgccttcagggggttgttacctgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433878 - DNA, 2832 bp, Homo sapiens
ggcggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacagtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcaaggatggtgtttcgggtggcgggatggggagcagcttggtccatgtgccttcagggggttgttacctgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433879 - DNA, 2469 bp, Homo sapiens
catgagtcagaatccccgtggtgcccatggcctccctgcctttcttttttctcaggctgtgtttatttatagtgccattccggtaccttccgaagctatctgtctgattcttttagggatcaattgcaaagagaccttgctattgggcagctttttagtcatttaatgcaaaatcgccacactgctttgcaggtcaggttttaatgatctggaatcgatccaagctaagtggcttttgatcttgctgcagagtgaagatgccccacagaagccaggagccgctgggcaacatgctccttattagagctgatggcttgattcttgctgcattttttagtctgtttcagagtgatttttcctttgtgtttgagcatgtgtggttttttttctcctaggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcaaggatggtgtttcgggtggcgggatggggagcagcttggtccatgtgccttcagggggttgttacctgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433880 - DNA, 2934 bp, Homo sapiens
ggcggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcaaggatggtgtttcgggtggcgggatggggagcagcttggtccatgtgccttcagggggttgttacctgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggaggggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433881 - DNA, 1756 bp, Homo sapiens
ttgaggaatcatttctctatggcccaagacgttttctcctctgcagttgtcatgttagtacctgccagcttttcctctcttacataaattccatgccagagcctggaaatgtgtgccctttgtaggaggggcatccacaggctggctcacctcagcagtgccaggcagagccccgtccctctcattgcaggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcaaggatggtgtttcgggtggcgggatggggagcagcttggtccatgtgccttcagggggttgttacctgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433882 - DNA, 1310 bp, Homo sapiens
ggcggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433883 - DNA, 1867 bp, Homo sapiens
ggcggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcctggtcagcctgtcccaggacagcccactccagaggcacaggagggtcaccaggcctgcggtgctgaattcacacttgccttgactttcagtctcgtcctgacacgattccaaaggtctgtccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacgga

SEQ ID NO: 433884 - DNA, 3136 bp, Homo sapiens
attttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaa

SEQ ID NO: 433885 - DNA, 3082 bp, Homo sapiens
attttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaactgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaa

SEQ ID NO: 433886 - DNA, 3083 bp, Homo sapiens
attttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgcctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaa

SEQ ID NO: 433887 - DNA, 3082 bp, Homo sapiens
attttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttcatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaa

SEQ ID NO: 433888 - DNA, 3560 bp, Homo sapiens
attttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaaaaaaaaaaaaaaaaaaaaaaaaaaaaaaaaaaaaaaaaaaaacagaacacagcaaaaaaaaacaacaacagccacgagaggcgacacaaaaagaagcagagaaacacgccgcaaacgctaagggggcagcccacaaaagaacagatagcaacaacgagcaacagagagcacaaaggcaacacgagcggcagggaagaacaatttcggaaggagaagcataagaacagggaatccacaaatcaagtgggacaacgccagcaccaaaacagataacgaaacccaccgatactatatattatagacacataaacggaaatcaaagcaaagacaaggatgagacaacaaacgagaaccaccaaacgaaaaaaacgagagaaaaaagagcgagacagcaacaaagagcaccaagcacatgacaaggcaa

SEQ ID NO: 433889 - DNA, 3166 bp, Homo sapiens
attttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaatcatttgcctactttgtttatactggagta

SEQ ID NO: 433890 - DNA, 442 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgtgagtaccgagccgaggagcgcgggaggggccaggacgcggggctggccttggggggcggctggggggctccggctgggccccgcc

SEQ ID NO: 433891 - DNA, 2658 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcagg

SEQ ID NO: 433892 - DNA, 425 bp, Homo sapiens
aggttgcatccacaaaacagtaacacagtgctatgcaaaaagaacattcagaggagaaaagaaccggtcctgaaataagatagcagaaattgaaagatcagtagaagagttggaagataaaattgaagaaatctcaaacgtggaacaaaaagacaagaaaattggagaaaacgataggagaaaatttaaaacaacaataaaaagaaccaggtcaggaaatccagcctccaggtaatgggtttcaacaagagagatcagagaaaaggaacagggattacaaagtaaggagtctgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433893 - DNA, 362 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgctgctgaacggcggcacggtagggggcggcggagcggcggcggaggagtggggggcggcgagcagagacgatgtcggagccgagcccgagagcgccacgcaggccggggaggacgaagacgaggaggaggacgacgaggaggaggaagatgagagcagcagcagcgacgggtggtgaggaggagagtagcgccgagagcctggtg

SEQ ID NO: 433894 - DNA, 228 bp, Homo sapiens
  misc_feature (180)..(180): n is a, c, g, or t
  misc_feature (191)..(191): n is a, c, g, or t
  misc_feature (193)..(193): n is a, c, g, or t
  misc_feature (201)..(201): n is a, c, g, or t
  misc_feature (208)..(208): n is a, c, g, or t
  misc_feature (212)..(213): n is a, c, g, or t
  misc_feature (222)..(222): n is a, c, g, or t
actttcaggctctgatcgcggccgcagtttttccttttttcttctgccgtcgccttctctgcctcttctcatcctttctcgctctgctgctctgcagtgtgacgagtccgaatcctccccagcccattccttgctgtcaaacaaacaaaaacccttgcaaaaaaaaaaaaaaaaaaaaanaaacaaaaaananaaagaaanacaaaanaaannaaaaacaanaaaaaa

SEQ ID NO: 433895 - DNA, 4146 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433896 - DNA, 4292 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433897 - DNA, 4248 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433898 - DNA, 4265 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgagttctttcctcatcatccataaatgtcattcattgagcatgtgatcagcttctcctagatagatgaaacattttgcctccaccaggagtgccttgatcctggtgagatacactttagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433899 - DNA, 4091 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttattgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433900 - DNA, 4200 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatcagcttta

SEQ ID NO: 433901 - DNA, 4092 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagtttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433902 - DNA, 4216 bp, Homo sapiens
  misc_feature (4168)..(4168): n is a, c, g, or t
  misc_feature (4179)..(4179): n is a, c, g, or t
  misc_feature (4181)..(4181): n is a, c, g, or t
  misc_feature (4189)..(4189): n is a, c, g, or t
  misc_feature (4196)..(4196): n is a, c, g, or t
  misc_feature (4200)..(4201): n is a, c, g, or t
  misc_feature (4210)..(4210): n is a, c, g, or t
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcataaaaaaaaaaaaaaaaaaaaanaaacaaaaaananaaagaaanacaaaanaaannaaaaacaanaaaaaa

SEQ ID NO: 433903 - DNA, 3848 bp, Homo sapiens
tgcggaggaagtcggattcctggggggcgcggggagcgcggtccccctctggtggagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433904 - DNA, 3388 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaagggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433905 - DNA, 3604 bp, Homo sapiens
tggatcgcaaggtcaggagttcgagaccagcctggccaatatgatgaaaccccatctctactaaaaatacaaaaaaattagccgggcatggtggcacatgcctgtaatccgagctatttgggaggctgaggcaggaggatcacttgagcagccccagagatggaggctgcattgagctatgattgtgctattgcacttcagcctggaatacaaagagtgagaccctggttttaaaaggggtgggggtaatagtattagaggaagcattaccagaatatgaactgtgacattatgtattctcactttaacctcattttcacagaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433906 - DNA, 4092 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433907 - DNA, 3872 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttatttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433908 - DNA, 3242 bp, Homo sapiens
tcacttgattcatccgtcgctggatttgggagcactggcaacataatcaacacacttcctacaatcttcaggcttcacatgtgctgatgatgatgtaaaccaactctgccccaatcatctccccttctcttagggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433909 - DNA, 3870 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagctccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433910 - DNA, 3894 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagtccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433911 - DNA, 3621 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433912 - DNA, 4409 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtacatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcaataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagc

SEQ ID NO: 433913 - DNA, 2660 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaagggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433914 - DNA, 3773 bp, Homo sapiens
  misc_feature (3725)..(3725): n is a, c, g, or t
  misc_feature (3767)..(3767): n is a, c, g, or t
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggaggggacgttccactctacagtggcatgtgggcagangcacctttaagagggacttggctgcgcaacagctgactcagnaacact

SEQ ID NO: 433915 - DNA, 2236 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagctccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcagg

SEQ ID NO: 433916 - DNA, 627 bp, Homo sapiens
acactttttcccttttttcgaaattttataccccccccctaaaaggaattttggccccctaggccaaaaatttcggcccaagggccccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcat

SEQ ID NO: 433917 - DNA, 1784 bp, Homo sapiens
actttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcagg

SEQ ID NO: 433918 - DNA, 484 bp, Homo sapiens
attggctttacgatgaacatgttagacattggtggaggattcacgggaactgaatttcaattggaagaggtaaacttctcagtagatgacattaacagaataattgctttctttgttacttaagtggtggatgtgtagagcaggatttttacaatggcagaaactaaaccctataacatctctttaaaattatgttcttagaaaaggaataggcagttagtagacctagctaactttgaaaagtttgatagaattctttgaacattatcataaaacattttctatttcagttgtgtttctgtacttaatggcacaaatgatttaatacttagaaaacttcactactacctttttttttttttttttaaagtcttcctgtgttgcccaggctggagtggagtggcgcaattatagctcactatagcttccaactcctgggctcaagcgatcctcctgcttcaacctcccaagtagctgggactta

SEQ ID NO: 433919 - DNA, 526 bp, Homo sapiens
gtttcagacctactcaaggtctcacatctatggtagatgtcattctaagcttctagtgctcttctggtcaattacttttaaaggtattctatgtggtaagtaacattttctgttgtaggtagaatgcagaggggacttaagcaacgttgtatatttttaaagctgtgagctgggtgctaagtcatcaaatgcctatgtaaaaataaaagtagaaatgcacctaggcatcttcagagtaacagtaatagtgtaaatttcagaatatcttttctcatttttaatgagtaaaaatccttttagaaaaatggttgatgtattaaggttgggtttcctgcttaggtatctctgaaacagtattctcaacctttcagctctccctgttctacttccagggaggtcttcacttcagaaatccaagactcatattcatccagcttggtgtcaagtgggctgttgctgccagaattatcttgtgattatttgagagatgtatcagtttcttctgaagtacaatcaactgtagaag

SEQ ID NO: 433920 - DNA, 1265 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433921 - DNA, 473 bp, Homo sapiens
ttcggtcgaacaagaactggcatacatcaatagatcatatactcattcacgcctgttgtcagacatgtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433922 - DNA, 457 bp, Homo sapiens
cgacgcgagtcagaggcacgaacagaggcggttgattcttcagatttctggtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433923 - DNA, 469 bp, Homo sapiens
tcacaacataaaaaccctttttaatcaccggcccccaatagactaactagattttatgtacaatatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433924 - DNA, 424 bp, Homo sapiens
ggcgaaagggttcgtgtaattgtcactggagctgcccccatgtccacttcagtcatgacattcttccgggcagcaatgggatgtcaggtgtatgaagcttatcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433925 - DNA, 536 bp, Homo sapiens
ggcccgtataccgaggtaacagtcaaccaaacagaataggacaaccacggaaatgttgtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaaaaaaaaaaaaaaaaaacaaaaaacaaaaaaaaaaaaaaaaaaaaaacaaaaaaaaaaaaaaaacaaaaaaa

SEQ ID NO: 433926 - DNA, 1365 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaaaaaaaaatattggcctctttggcctcagcgggggagctttgcgccctttccttctgttaggggtaatttataatcttcgtacccaactcctgtgtctgg

SEQ ID NO: 433927 - DNA, 1364 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaaaaacaacaaaacaagcaaagagaagaacaacgaacaaccagaagccaaaccgaagcaagcgaacaatacaatcaagactaacgaaacaagcaaagggg

SEQ ID NO: 433928 - DNA, 1413 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgacacgaacaaacagacaaaacaaaactcggaaggaatctatatatagggctgcgaaaaaaagaggtactgcaatgtgcccagtggccaagggtggtacgtacccaactatctgtcacaagtgggaaaccttgcggtcccccaaaagagt

SEQ ID NO: 433929 - DNA, 1338 bp, Homo sapiens
  misc_feature (14)..(15): n is a, c, g, or t
  misc_feature (24)..(24): n is a, c, g, or t
ccgagcgactaagnntggatcaanaaaaaagccagggcgtgtattatataccgaaccggccagtacttacgtctagtacgagctggtgcgaatcgacgaagaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433930 - DNA, 1288 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaagacactcgggtcatctaggtcg

SEQ ID NO: 433931 - DNA, 1364 bp, Homo sapiens
  misc_feature (1267)..(1267): n is a, c, g, or t
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaanaaaaaaaaaaaaaaaaaaaaaaaaaaaaaaaaaaaaaaaaaacaaaaaacaaaaaaaaaaaaaaaaaaaaaacaaaaaaaaaaaaaaaacaaaaaaa

SEQ ID NO: 433932 - DNA, 1322 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaacaaacaaaacacaaagggggggccctcgggattctaaaacctaggtgctaaatcga

SEQ ID NO: 433933 - DNA, 1337 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaaaaaaaaaaaaaaaaaacaaaaaacaaaaaaaaaaaaaaaaaaaaaacaaaaaaaaaaaaaaaacaaaaaaa

SEQ ID NO: 433934 - DNA, 1293 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaactgcttgctcatttgaaaaaaaaagta

SEQ ID NO: 433935 - DNA, 1244 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaaattttggctataacagtgtctttctagccataataaaataaaacaaaatcttgaactgcttgctcatttgaaaaaaaaagta

SEQ ID NO: 433936 - DNA, 1235 bp, Homo sapiens
  misc_feature (1140)..(1140): n is a, c, g, or t
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgagttcccnggcacctggagaattttgtttgaagccgggttcttagctgcgatgggttaagtttgccttaaaaactaaaaaaagggggagtccggcggggccta

SEQ ID NO: 433937 - DNA, 1509 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcattgcgccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433938 - DNA, 944 bp, Homo sapiens
  misc_feature (916)..(916): n is a, c, g, or t
  misc_feature (919)..(920): n is a, c, g, or t
  misc_feature (930)..(930): n is a, c, g, or t
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccgcaggagaattgcggcagaacgggaaacccgtcctgggggnacnncaattaaacnccaacgcgccgggg

SEQ ID NO: 433939 - DNA, 1252 bp, Homo sapiens
ctgtaacagggaaggttcacgggctcatgagtgtccaacatgtctccagcgtcctccgcctcgcagccagccagcgtgaccggtgacaacgtgatggggccgactcgggagatctcagccggtgacacgcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433940 - DNA, 1386 bp, Homo sapiens
  misc_feature (14)..(15): n is a, c, g, or t
  misc_feature (24)..(24): n is a, c, g, or t
ccgagcgactaagnntggatcaanaaaaaagccagggcgtgtattatataccgaaccggccagtacttacgtctagtacgagctggtgcgaatcgacgaagaagatggcgtcccgcaaggaaggtaccggctctactgccacctcttccagctccaccgccggcgcagcagggaaaggcaaaggcaaaggcggctcgggagattcagccgtgaagcaagtgcagatagatggccttttctctggtcaggtatcctctcagaagcccttcctggatccccctaaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433941 - DNA, 1108 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggcctttccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433942 - DNA, 1213 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433943 - DNA, 1333 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacacactagaaaggagttccgaaagagtaactgactctgagtcccccggcgtctgggaatattggttgaagccggatttttgtctccgtgggaaccgtttcgcaaacaacacaaaaaagccgtggcgggagaattgtcgggagggcggcctttgcccgttcagcccctactctacctctcctgttgctacacccaccagcgtgtagtcacacaagagcgacaacgcgaagcagaacgtaacgcacgcactgagagcagcgacgacgaggacaacaggaagcagacaatcagacgcacgacacagcacgcagactaggagaaagagaggcgagcagacagcacgcgagtagcaacaagagacgacaacacaggtg

SEQ ID NO: 433944 - DNA, 847 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433945 - DNA, 500 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagagtcagtctgtatgcctttagtgagagagatccttgggcagtttttatgggatcataa

SEQ ID NO: 433946 - DNA, 389 bp, Homo sapiens
tggggtgttcgaggtccctcggatgaagtgtctctggatgcaagtgtcgctggatgcaaagtgtctctggatgcaaagtgtcacagccgcctgccaggatggactcgctgctcatgcgccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433947 - DNA, 516 bp, Homo sapiens
acatacattgtctgatgacatggctccctcattcctctcctattaaaaagagcagagttggccgggcgtggtggctcacggctgtaatcccagcactttgggaggccgaggcgggcggatcaggaggtcaggagttcgagaccagcctgaccaacatggtgaaaccccgtctctactaaaaacacaaaattagccgggcatgttggcacgcgcctgtaatctcagctactcaggaggctgaggcgggagaatcgcttgaacctgggaggcggaggttgcagtgagccgagattgtgccactgcactccagcctgggcaatagagcgagcctccaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433948 - DNA, 291 bp, Homo sapiens
gagattatagttggaagttcggtatggaaagtttagtaacaagttgactcagattttttcctctgctcttgcttttatgcatatgtgtgctctcattcttttagcaaaagccagttcaagttcatatcttaaaactgtttagagcagtagcaaagctataatttaaagtaagacttgtcagtatatttactttacatttcagcaatcatttggggaagaatctacagttgctgatggacagagtggatgaaatgagccaagatatagttaaatacaacacatacatgagga

SEQ ID NO: 433949 - DNA, 1206 bp, Homo sapiens
ggggagtggaccagatctcggacgcgtgtacacatggtgtacgagcaggccaaggcgcgcttcgaggaggtgctgtccaaggtgcagcaggtgcagccggccatgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433950 - DNA, 1244 bp, Homo sapiens
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgcgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttga

SEQ ID NO: 433951 - DNA, 827 bp, Homo sapiens
  misc_feature (765)..(765): n is a, c, g, or t
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgtatttaactatatcttggctcatttcatccactctgtccatcagcaactgtagattcttcnccaaatgattgctgctggcaaggctgagcaattcatgtttatctgcagtcgacgcggccgaa

SEQ ID NO: 433952 - DNA, 1078 bp, Homo sapiens
  misc_feature (983)..(983): n is a, c, g, or t
agcggctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggcctttccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgagttcccnggcacctggagaattttgtttgaagccgggttcttagctgcgatgggttaagtttgccttaaaaactaaaaaaagggggagtccggcggggccta

SEQ ID NO: 433953 - DNA, 2510 bp, Homo sapiens
  misc_feature (2499)..(2499): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433954 - DNA, 837 bp, Homo sapiens
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaggaaaaatcatatgagattccactcctttacttggaaccaaacgggccagatcaattcttggaagacctatgtatccttaactaaccataacatcttcataacttaactaa

SEQ ID NO: 433955 - DNA, 507 bp, Homo sapiens
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgaggcagggtctcactatgttgcctaggctggtctcgaactcctgggctcaagcaatcctcgtgcctgagcctcccagaatactgggattacatgtgtgaaccaaatgttctgaatttatctaggtaa

SEQ ID NO: 433956 - DNA, 3007 bp, Homo sapiens
  misc_feature (2499)..(2499): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgtaaaaagtcaatggcagattattaaatttctttatttttttcattatcctgttgtacacattttaaacatacatatctgaacaagaacagaaaagggccataaaagtcttttcctcctttttagtagttctggccaaagacagtttaagaaaaggctaatataattgactcttttagggttatttatagattttagtaggaagcagcacatagagaaagagcatgaactttgaattcagacctaggtcaaaatcctttttttttctctctctctctctacccagagatggggctgctcaggctgctctgaacccctgggctcaagcagttttcccacctcagcctcccaaatagctgggactaccaggcacacaccaacaagaccagtgcaaaatcctgtctttaacttactgtgtacaagataggaaaaaccaaacacttatacccaatacagcacagaacacgaggtcaccaaaatgtgtggtttttcttctcacgc

SEQ ID NO: 433957 - DNA, 2437 bp, Homo sapiens
  misc_feature (2426)..(2426): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433958 - DNA, 2453 bp, Homo sapiens
  misc_feature (2442)..(2442): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgagaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433959 - DNA, 2348 bp, Homo sapiens
  misc_feature (2337)..(2337): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagagggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433960 - DNA, 2449 bp, Homo sapiens
  misc_feature (2438)..(2438): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgaggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433961 - DNA, 2432 bp, Homo sapiens
  misc_feature (2421)..(2421): n is a, c, g, or t
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433962 - DNA, 1072 bp, Homo sapiens
  misc_feature (1061)..(1061): n is a, c, g, or t
aggattccccaaagatctttgagcatcacctggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaangttgtcatgta

SEQ ID NO: 433963 - DNA, 1550 bp, Homo sapiens
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtaagttagaccatcaaatcatgctgta

SEQ ID NO: 433964 - DNA, 1402 bp, Homo sapiens
atgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggtatagaatagcatttatatatcattctaccactagatggtttaaagctttaagaatctgttgtagatttttagggggaatgg

SEQ ID NO: 433965 - DNA, 267 bp, Homo sapiens
gatccacaagtcgattgctattggctctcagccagtgctcactgttgggacaacccacatatccaaattgacagatgaccaactcataaaagagtttcttagtggttcttactgctttcgtggggtgagaagtaaatcttcagtttaaatatttattttacaactttacctgccaggtatggtcagtgggcatcagcagcactgaaaagaatttttctctagagaaatgacaggatcctttcatccccaaagaacattttctttttg

SEQ ID NO: 433966 - DNA, 4005 bp, Homo sapiens
acaggctctttcttctggggccgggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttaggtattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtaaaaaaaa

SEQ ID NO: 433967 - DNA, 3843 bp, Homo sapiens
acaggctctttcttctggggccgggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatgacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttaggtattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtaaaaaaaa

SEQ ID NO: 433968 - DNA, 4074 bp, Homo sapiens
ctgcccactgtttgaaaaagtgcctatggattttatcctataatctctctattgatagactacatatcaatacatacacgctaatgtaatgctacatttgtattaaagaattgcataattttcctttctgatggtcaatagcatactaatcaatacaaatattaagtctgtactagtattaacattccctccccacatataactcaatatacatatgcacatttatctatgactcagatgctggaaaatcataacctattaaattacttttgggattgattttgaaaatttatcttatatgaaaaattaaatttgagcactacaatgcttgtgaagagtattgcttttggaagatattattcttgaaacttgaaattcattttactttgtttgtatctcactacacataaataaatttgagataaaaatacattagtcaatctggcagacatatgagaccggttatggagtattcacaatgcctaaagcagtggtgtatctgtcaaaggaggaaaaagtgggagaaaaggaggtataggtttgtttatctcaagttgcaaagtaaatgcaaaagtgactcatcgaccactctgttttagaggtagattaatattttgcgtttataccttgagatacttttatttcctattgatcttccactataagggtgactctaacagcacctttaaattccttctacctattctttatctaaggtagtttatggtcaataataaaggaataataaatgccttagggaaactattttaaaggaacctatttgtgaattattttttaagcagttttttggtattattagtgtttccgtattctctaatttatctgttaaagtgtgtatattagattttcttaagaaggggcacacatctatcaacattctaaatcattttaggtcatataagtttaagaaataagtagtttattgtaaaaaaaattattttatccttgctagatgataagcttcttgaaggcaaatataatagcttaaggatcctggctttaaccttctatagcctcttacacatgaaaggtatccccaggctctgtggagagagagagtgtccccgagagaaggcttcctgaggtagtttcattttctaggttttcatcatgagtgattgtttctgtgttctgtgcccaataataaacaggctttgtgttataccttaatttaaatcgttgcctaacagcattttaaagtgtccagaaacaaaaagatgaaaatgtttacatttgcagctcaagctcttttaactttataaatagaaataacatttctaagaagttgcatacaaacgacattgtacttacaccagtctaaaggttaatattgcatattgttttcaattaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttaggtattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtaaaaaaaa

SEQ ID NO: 433969 - DNA, 2876 bp, Homo sapiens
acaggctctttcttctggggccgggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggctggagtgcagtggcatgatctctgctcactacatctgcctcccgggttcaagtgattcttgtgtctcagcctcctaagtagctgggatcgcatgtgtgtgccaccatgtgtagcgtaattttcagtattgtgagtagagataggatttggctaagctggcaggttggtttcaaactcctggtctcaagtgatccgccactttgggctccaaagtgctggattacaggcgtgagccacaaactggcttaaaattatcttagaacagggaatggccacaaatccaagaaggcaaggttcatgggactaaggagcagggtatactgttggctttcctggggtattacaagaatggaggagaattccactgtaaagaatacgggggtaaccttacatatatagtgatggttcgaaggttattgctaagaggatatatatacgagggattttagaaacattgggacatagcgggagcaaaaaacgggggtaaacaagaaacagctaataaggaaagggtgaagaaaatagaaagaaaagatatcaagatatttgtgtgcgtgtttcgcttg

SEQ ID NO: 433970 - DNA, 1470 bp, Homo sapiens
ggaaggtcaatgtgtgagggtgcatagtggagactcggggaccaggctcgacaaagatgaattgttttaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttaggtattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtaaaaaaaa

SEQ ID NO: 433971 - DNA, 886 bp, Homo sapiens
ctggcggaccccactactggctccactactggcttggaactgttggtcatcagttggcaaaggactccctctcctggattagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtaaaaaaaa

SEQ ID NO: 433972 - DNA, 448 bp, Homo sapiens
atcatccctaatacttccatgtttcagaattaaaaatgatttctaaaaacattacctaagcattatattactaaagcaatatgaccaaaaaatgttatttccaagaattgatgaagaaattttacataaaagataattgagcattaatacttagtaaatgaaattctaactggttttatcttcaacagacaaacaacagaaaggtgaatttgcaatagatggctacagtgtcagaatgaataacactctaagaaaggatggaaagaaagattgctgttttgaaatctctgctcctgataaacgtatatatcaggttgtagtttttatgttgccttgaaattaagttgataaaatgttttgatttcatttatagagacattaacatttgattaatactttccttgacatgttaacaataataaaaatactgatgtttaaatatattatg

SEQ ID NO: 433973 - DNA, 2317 bp, Homo sapiens
cgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433974 - DNA, 953 bp, Homo sapiens
  misc_feature (27)..(27): n is a, c, g, or t
  misc_feature (34)..(34): n is a, c, g, or t
  misc_feature (37)..(38): n is a, c, g, or t
  misc_feature (831)..(831): n is a, c, g, or t
  misc_feature (838)..(838): n is a, c, g, or t
  misc_feature (840)..(840): n is a, c, g, or t
  misc_feature (845)..(845): n is a, c, g, or t
  misc_feature (849)..(849): n is a, c, g, or t
tacatgctattacctggtagatcgccntgttgtnaanntttttccgaaagctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggncggacgntnccggnaggnccaggtgggggggtgaggggattggcagaatggaggccggtcagaaccccacaaaattctttgggatagggaggtaggggagggcccaggaaatggggaagaag

SEQ ID NO: 433975 - DNA, 301 bp, Homo sapiens
ctgctgcctgtcaagaacatggctttcttcctgcccccctccactgctgctaactggagtctgaccttcgagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgcttt

SEQ ID NO: 433976 - DNA, 2458 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433977 - DNA, 2014 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgcttt

SEQ ID NO: 433978 - DNA, 2205 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaaaaaaaaaaaaaaaaaaaaaaaaaaaaaaaaactcgggggtctttttgggggggggggaacacgggggtttttagaatggggcttggggtcatagtttttccgtggccccgttttttttgtcccagggggggaaatctggggggcccccatataggagggcggaattaatttggaaaacgcgggtacggt

SEQ ID NO: 433979 - DNA, 2525 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaaaaaaaaaaaaaaaaaaaaaaaaaaaaaaaaaaaaaaaaaaaaaaaaaaaaaaaaaaaaaaaaaaaaaaagggggggggaaaaaaaacaccaatcagcggcgagagccagtaaaccaccagtcagcacaggccgcaccacggttgttgaaataagcgaagacgcggccacagccagcagagggaggagtaattacaaacggcgggcggggcactccagcgtgacaccacaaacacggcgccgggcagacggcaaaaccagcgcgccggacgcacgggagcacgagcggagaggcgccacaccctgatggggcggggggggagaccaaacgacgcagggtcacccgcccaggcgtgaagcgaatcccccgacaccgggggaacgcatcaacaacaccacgcgagcggccagctgaatggagagagcgagaagcgccgagggccgaaggcacggggcaacaaaagaagtggccggcgcaggtaatgaacaagagactccgcccagggacagc

SEQ ID NO: 433980 - DNA, 2360 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaaaaaaaaaaaaaaaaaaaaaaaaaaaaaaaagggggggggggtaaaaaattcccccgaggagggcggccaagtttatagcgcgtccccaggtttctgtggtacaaggggccccaatagggggaggcggaaataaagcagcaggcggacgggcgcggcgtaaacaaagcgtcgttgcggggaaactgggtccttggcactcttggggaaaggacccctactgcggggggcgacacttttggcacagcaacaacaaaaaattaaagccaagggacattaaccattaggtgtattctgtgcacccaacggatattgcggccggaattgggcaccggttattgacatca

SEQ ID NO: 433981 - DNA, 2156 bp, Homo sapiens
  misc_feature (3)..(3): n is a, c, g, or t
  misc_feature (6)..(6): n is a, c, g, or t
  misc_feature (2154)..(2154): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaaaaaaaaaaaaaaaaaaaaaaaaaaaaactcgagactagttctctctctctcctggggttagggttctttgtttttggggtttggcagagatgtgtttaagtgctgtggccagaagcggggggagggggggtttggtgnaa

SEQ ID NO: 433982 - DNA, 2542 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggtcagggccggcgcggcttgaggccgcgagggtctggagggggcgtctattctgaggcgtttgcggcccggaaggagcgggaaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433983 - DNA, 2452 bp, Homo sapiens
gcagagatgcgcgggtctgcctaatgtagtgtcgagaagcgaggatgtgctagtgcaggcgtgccatatcagctgacgtgatggcggcggccagataagggtgatcgctgtggcgactggagtgccagaaacggtgcgggctcttgtcatccttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433984 - DNA, 2616 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433985 - DNA, 2516 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctatgggatttttccttgggtggctgcattctttgaaacaccaaaggaacacatttctctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433986 - DNA, 2540 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggaaactgaaggtctgaccatctttggggagttgtgaagtcttgacagaggaggggagatctgagctgtatttctcggaacagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433987 - DNA, 2313 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433988 - DNA, 2062 bp, Homo sapiens
  misc_feature (3)..(3): n is a, c, g, or t
  misc_feature (6)..(6): n is a, c, g, or t
  misc_feature (2060)..(2060): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaaaaaaaaaaaaaaaaaaaaaaaaaaaaactcgagactagttctctctctctcctggggttagggttctttgtttttggggtttggcagagatgtgtttaagtgctgtggccagaagcggggggagggggggtttggtgnaa

SEQ ID NO: 433989 - DNA, 2401 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433990 - DNA, 2243 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433991 - DNA, 2105 bp, Homo sapiens
  misc_feature (335)..(335): n is a, c, g, or t
cccacgcgtccggacccacgcgtgcgcccacagctgtccgtggaaccgaggcgtccgcccacgcgtccggatacacattgtgccaaatctaggagatgcatgagtttgtagaggtagaaaactaaagtggccgaacgttagccaaggagtagaacgagtgggcccgagcaccacgaggagactcaacgtgattcttctgagacaaccgatgggtgcagaacaatgaaatgggtgagtcatatcctaagcctcagtgatgtcagaaatgtataagcacgccttggtaagggtgtgaacttggtaagacaagttgacgaaaaggtcgtaatgagctngtcgttctgacagtcaggcactgacccttcgcgacgtacgtttcgtcacttctaatgttggctcattagaaggttatcgcagttagcatggataaatggtacagtagcatcacgcgaggtctcaggagtacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433992 - DNA, 1539 bp, Homo sapiens
  misc_feature (3)..(3): n is a, c, g, or t
  misc_feature (6)..(6): n is a, c, g, or t
  misc_feature (1455)..(1457): n is a, c, g, or t
  misc_feature (1460)..(1460): n is a, c, g, or t
  misc_feature (1468)..(1468): n is a, c, g, or t
  misc_feature (1471)..(1471): n is a, c, g, or t
  misc_feature (1476)..(1476): n is a, c, g, or t
  misc_feature (1478)..(1479): n is a, c, g, or t
  misc_feature (1482)..(1482): n is a, c, g, or t
  misc_feature (1486)..(1486): n is a, c, g, or t
  misc_feature (1493)..(1493): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctgtcggannnctngactttgngtnttccncnngancttngagaagnggatcgggggatgccagcctggggcgggcgtccttagggtaaagac

SEQ ID NO: 433993 - DNA, 2371 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctatgggatttttccttgggtggctgcattctttgaaacaccaaaggaacacatttctctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433994 - DNA, 2201 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctggctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaaaaaaaaaaaaaaaaaaaaaaaaaaaaaaaaaaaaaaaaaaaaaaaaaaaaaaaaaaaaaaaaaaaaaaagggggggggaaaaaaaacaccaatcagcggcgagagccagtaaaccaccagtcagcacaggccgcaccacggttgttgaaataagcgaagacgcggccacagccagcagagggaggagtaattacaaacggcgggcggggcactccagcgtgacaccacaaacacggcgccgggcagacggcaaaaccagcgcgccggacgcacgggagcacgagcggagaggcgccacaccctgatggggcggggggggagaccaaacgacgcagggtcacccgcccaggcgtgaagcgaatcccccgacaccgggggaacgcatcaacaacaccacgcgagcggccagctgaatggagagagcgagaagcgccgagggccgaaggcacggggcaacaaaagaagtggccggcgcaggtaatgaacaagagactccgcccagggacagc

SEQ ID NO: 433995 - DNA, 2204 bp, Homo sapiens
  misc_feature (3)..(3): n is a, c, g, or t
  misc_feature (6)..(6): n is a, c, g, or t
aantcngctaggtacgaggctggtgttaaggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggttcttggctgccttcgtggactccggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433996 - DNA, 1967 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 433997 - DNA, 1188 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggttcttggctgccttcgtggactccggccctgtctcagcgggaccctcctcacaacaacttcttcttcttcgatggcatgaaggggaatgggattgtggagtgccttggccccaagtgaactcaagatttggcagccccagagatgccaaggacccactgcagggacccagtcggcagggacccacacggcagggaccactcg

SEQ ID NO: 433998 - DNA, 1039 bp, Homo sapiens
  misc_feature (3)..(3): n is a, c, g, or t
  misc_feature (6)..(6): n is a, c, g, or t
  misc_feature (917)..(917): n is a, c, g, or t
  misc_feature (924)..(924): n is a, c, g, or t
  misc_feature (926)..(926): n is a, c, g, or t
  misc_feature (931)..(931): n is a, c, g, or t
  misc_feature (935)..(935): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggncggacgntnccggnaggnccaggtgggggggtgaggggattggcagaatggaggccggtcagaaccccacaaaattctttgggatagggaggtaggggagggcccaggaaatggggaagaag

SEQ ID NO: 433999 - DNA, 1833 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaatacctagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaaga

SEQ ID NO: 434000 - DNA, 850 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttacctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccagaacaaatacctttaaaaagctgggacctgtggtgtacctaaaggataatacagatgttcctctcaacttagcatggc

SEQ ID NO: 434001 - DNA, 682 bp, Homo sapiens
  misc_feature (3)..(3): n is a, c, g, or t
  misc_feature (6)..(6): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccgatgggaatggtctgtcacaatctgctccttttttttgtccgccacacgtaactgagatgctcctttaaataaagcgtttgtgtttcaagttaaaaaaa

SEQ ID NO: 434002 - DNA, 1170 bp, Homo sapiens
  misc_feature (3)..(3): n is a, c, g, or t
  misc_feature (6)..(6): n is a, c, g, or t
  misc_feature (760)..(760): n is a, c, g, or t
  misc_feature (892)..(892): n is a, c, g, or t
aantcngctaggtacgaggctggtgttaaccggcgccatggtggagaaggaggaggctggcggcggcattagcgaggaggaggcggcacagtatgaccggcagatccgcctgtggggactggaggcccagaaacggtcagggccggcgcggcttgaggccgcgagggtctggagggggcgtctattctgaggcgtttgcggcccggaaggagcgggaaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaaggtggtcttctgncctggtttaagaaagccctggtagttggactgggagcagtggggaaaggcaaagggggtcttgaaagggccagaacagtcggagaaaatatatccgctcaaaggggggccttaaagtccgggcagataaagnaggggagaagtcccacggctggtaataaatagaggggagacaacatcgagggagggggccccataacaaacaacgcagggtgggacgcccacagcggagagagatacatgaagcagaaccgctaaagacagaggctagcaagagcatcgccaggcacgcaactatcggacgaggagagaaccagagtaagcaaaaaagcacggataggggaagaccaacaacgacattacctggacagcaacgacgaagaaggacggacacaacagagcgaccgaaca

SEQ ID NO: 434003 - DNA, 720 bp, Homo sapiens
caatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggcccca

SEQ ID NO: 434004 - DNA, 571 bp, Homo sapiens
ttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcagggttggtgtcagtatttatcactgtttagtctggacaga

SEQ ID NO: 434005 - DNA, 4761 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434006 - DNA, 5272 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgcttttattttagattcagagtctacatgtgcaggttgttacatgggtgtatggatgatgctgaggttggggtacaaatgatcccgtcacccaggtaataagcatagtacccaacaggtagtttttttagcccttgtcctcctccccatctccctagtgtctgttattcccatctttatgtccgtatgtacccaatgtttaccgccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434007 - DNA, 5284 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagcttagattccctggaggattgaagattggggtttggccattcttcataggtgaaattaaaaggggacttggcatataattatagaggaccacgaaggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgcttttattttagattcagagtctacatgtgcaggttgttacatgggtgtatggatgatgctgaggttggggtacaaatgatcccgtcacccaggtaataagcatagtacccaacaggtagtttttttagcccttgtcctcctccccatctccctagtgtctgttattcccatctttatgtccgtatgtacccaatgtttaccgccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434008 - DNA, 5324 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagcttagattccctggaggattgaagattggggtttggccattcttcataggtgaaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgcttttattttagattcagagtctacatgtgcaggttgttacatgggtgtatggatgatgctgaggttggggtacaaatgatcccgtcacccaggtaataagcatagtacccaacaggtagtttttttagcccttgtcctcctccccatctccctagtgtctgttattcccatctttatgtccgtatgtacccaatgtttaccgccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434009 - DNA, 5226 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgcttttattttagattcagagtctacatgtgcaggttgttacatgggtgtatggatgatgctgaggttggggtacaaatgatcccgtcacccaggtaataagcatagtacccaacaggtagtttttttagcccttgtcctcctccccatctccctagtgtctgttattcccatctttatgtccgtatgtacccaatgtttaccgccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434010 - DNA, 5270 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgagcattgcttcagagtttggagttcgaggttatccaacaattaagcttagattccctggaggattgaagattggggtttggccattcttcataggtgaaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgcttttattttagattcagagtctacatgtgcaggttgttacatgggtgtatggatgatgctgaggttggggtacaaatgatcccgtcacccaggtaataagcatagtacccaacaggtagtttttttagcccttgtcctcctccccatctccctagtgtctgttattcccatctttatgtccgtatgtacccaatgtttaccgccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434011 - DNA, 3774 bp, Homo sapiens
ctctagaggatccaccgccatttacaactatctctagaaatatcaaacaaattaaaaagtgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434012 - DNA, 3706 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctct

SEQ ID NO: 434013 - DNA, 4440 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactctttttttaaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434014 - DNA, 1325 bp, Homo sapiens
atctgcgtccatcagcggatctatacattgacctcttgttgttatcaaaacagcagtctgatgggaggaagactgcatcttcgtcccatcaggatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434015 - DNA, 658 bp, Homo sapiens
attcgtgtccctaccccttcgacacggtgcgtcggcgcatgatgaagcagtccgggcgcaaaggagctgacatcatgtacacgggcaccgatcgactgttcggaggaagatcttcagagatgaggggggcaaggccttcttcaagggtgcttggtccaacgtcctgcggggcataggggggcgccttcgtgctggtcctgtacgacgagctcaagaaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaata

SEQ ID NO: 434016 - DNA, 1468 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgcttttattttagattcagagtctacatgtgcaggttgttacatgggtgtatggatgatgctgaggttggggtacaaatgatcccgtcacccaggtaataagcatagtacccaacaggtagtttttttagcccttgtcctcctccccatctccctagtgtctgttattcccatctttatgtccgtatgtacccaatgtttaccgccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattgagtatgaagatggtgatctgtcatcatggatcaacagggaaaggtttcagaattaccttgctatggatggcttcctcttgtatgaacttggagacacaggaaagcttgtggtctctgcagtactgctgagaacaatacctcagttgaaccataccagattgccagtcactcattcagga

SEQ ID NO: 434017 - DNA, 785 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgaggtaatatttaaaatttgattttaacgacacaattttatttattaaattattacttgatttaataaactaaattg

SEQ ID NO: 434018 - DNA, 1094 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatggtaagttccaaatctttaactcatgtaaaacattttaaaattaaaatgtctgttatacaacttaggtgtaaagattatgtaaatgcttctactgttcaatgagaataacagttctcatgacttgaatgcctgatgttttgggttttttttcacccttcaacttataattgttagttatttttattctgagctttacctacacaacattctttttgttgttgtttgttaaattatatgcgtttttgaggaataaattctatgtgatttttatacattactttaaaatgttcagaattcatttttttgaagtaacatt

SEQ ID NO: 434019 - DNA, 1189 bp, Homo sapiens
agccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagtaagacttttttttaatccacaaaaacagatgtattgtaatttaatttactctataatcaagacttcactagaaacgcagaacttattactctgcacttactggaaatattttcattcattctaagcatttcttataataaaaacacttccttctataccttctgtcatgttttcctatatgaaacagaagtgtgtaaaaagtgagtaaatgttgcctgccttagcatttttttctgttattaacctggttatttaagtcttgtgttgctttttcaaattctgagtctttgagactgcagactttgtatgtgtgtatacacacatatcttcctataatcatcaccatcattttgtctaatttataattaaatgaatacatacaaattgaacttgtgttatatttaatgaactttatttgcagaaagataaaagctcttaattacgttggcctttgccttggaaacaattttatttgcttacatttcttctcttcacctaagaggatgtaaggtagcacattaaggtgatgactcttactacataaggtaactctc

SEQ ID NO: 434020 - DNA, 200 bp, Homo sapiens
gtaagtaaagtgctgaatgattttgctgtcaaatctattaatttttaaatttgtttctgagatacaggtagaaggattaaatagctgaaaaatagcaaacagttgacatattcagatgcagatattctcccattaaatattttactttagttttccaattctgtatttggaacttaactgactttaatattggtctatag

SEQ ID NO: 434021 - DNA, 208 bp, Homo sapiens
gattgaagattggggtttggccattcttcataggtgaagtatgtaattaaaggagagggactgcttctttatgcttttcttcgtatttaagcaatcatgttgtttatggctaattcacgtgttttgcttgctgtgtgacacgcactgtgcaggacaagtatacagtcataaattatgaaaggtcttttacccttgaggagttcaagtg

SEQ ID NO: 434022 - DNA, 676 bp, Homo sapiens
gtggtacgtcccgagctcggctgggcccaagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434023 - DNA, 755 bp, Homo sapiens
gtggtacgtcccgagctcggctgggcccaagatggcggcctccgtgtgcagcgggttgctggggccacggtgagtggggcgactcggcaggtccctgcgagtcggaggtggggtccctagtttccgcctcacgcgccctccctccacaggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434024 - DNA, 508 bp, Homo sapiens
cgcttttggatgttgactctggagttatggcagggccctggggcaatgaggctgattcttctattatgcccttccctcttcaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434025 - DNA, 375 bp, Homo sapiens
gcggccgcgcggaggaagcgaaggaggcgggagcggagacctcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagatcaggatactgggcccagagcttccaaacaacctgccaagggccacacactgggcagaagtgttttctttgtctttttcccattgccttttactaccatgctacttaaaaaataaaaagttattccatgtctggacaagaaaaacaa

SEQ ID NO: 434026 - DNA, 4437 bp, Homo sapiens
cggccgcgcgggcgtggggggcgggcgggggcgccggcggaggacagcggtcccccgggatgcgggggtccgggtacgcgggcctaggggatccggggagggcgcgaggcccggaggtgcccggggcgcggcgggagcgagggcccggcgagcggctggggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagagagaaaaaaaacacaaaaaaacattaactagaaagccagagagtgattcagtgattatgactcctgtgggaacttcccggtgactctgagtagcccacggaagcaacacagtggggagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434027 - DNA, 612 bp, Homo sapiens
tgactggggggacatggcgcgaagtaggggtctggatcggggatctcgtggagtcacggccccttttgctcctagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434028 - DNA, 830 bp, Homo sapiens
  misc_feature (735)..(735): n is a, c, g, or t
  misc_feature (739)..(739): n is a, c, g, or t
  misc_feature (745)..(745): n is a, c, g, or t
  misc_feature (753)..(753): n is a, c, g, or t
  misc_feature (755)..(755): n is a, c, g, or t
  misc_feature (757)..(757): n is a, c, g, or t
  misc_feature (766)..(766): n is a, c, g, or t
  misc_feature (774)..(774): n is a, c, g, or t
  misc_feature (785)..(785): n is a, c, g, or t
gtggtacgtcccgagctcggctgggcccaagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttgaaaaaacacaaaaaaaaaaaaaacccgggggttttttgcgggggggggaaaaggggttngaangggccntgggtctngngnttctggccngtttttgncaagggggaantcgcgggtccccaaaagggggggataaattgaaaagccggtacta

SEQ ID NO: 434029 - DNA, 653 bp, Homo sapiens
cgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgcctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434030 - DNA, 1175 bp, Homo sapiens
cggccgcgcgggcgtggggggcgggcgggggcgccggcggaggacagcggtcccccgggatgcgggggtccgggtacgcgggcctaggggatccggggagggcgcgaggcccggaggtgcccggggcgcggcgggagcgagggcccggcgagcggctggggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggtgtgtgttcagtggtaggggtggggaggggacggtgctaaggggccgggatcatggatttcgtgcctcctccagatgaggcctgagccatgccctggggtgatttggctcagtacagtgggcctgaatgaagcaagctgaatttgaaccccgcctgctgtctttctaggctttggggcagtggtcatttccgggaccaggccttttcattgccagctgactacccagcactttgagctcatgaatagagtaagcagggaaccatccctgggaaggccaggctgattgacctaggggttcaaggtcctgcagcattcctttcccccttgtcaggaaagggtggggcagagcctcctggaggcaatgttgagggtggctgaacctgtgtggggctgccctgaacgaagcttta

SEQ ID NO: 434031 - DNA, 845 bp, Homo sapiens
gtcgccgcgtgccgagcgtcctggcgcggccgaggggaagcagcggggctgcccgggttacgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctgtaagtatatataccctcgtacgccttatggctggatgcgttacagccatttccatgtagatgtctgtgcatacgttcacacgcaaaactctccgcagttttggagatctccgtgttcagtcgtacctcacgtgatcttgcactgccaacattgagaaccctggccttagactatgcatctcccaaacttaattatctgtctccttcctattttcccaagacttggcaggcgtctaggtcagagttgttcaaactgagggttatgaactagtgtgtcacgaaatcaatttaataggttgcaaccaacatttttttgaaaaaaaaaaaaaaaaagccagacgaggtggctcacgcctataatcccagcactttgggaggccgaggcaggcggatcacttgaggtcaggagttcgagaccagcctggccaacatgctgaaactccgtctctactaaaaatacagaaattagctgggcgtagtgacgtatgcctgtaatcccagctacttgagaggctgaggcacgagaatcacttgaacccaggaggcagaggttgcagtgagctgagatcacactgttgc

SEQ ID NO: 434032 - DNA, 3621 bp, Homo sapiens
gcggccgcgcggaggaagcgaaggaggcgggagcggagacctcgctgcgctcatggcgtcgcccgggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434033 - DNA, 3821 bp, Homo sapiens
gtcgccgcgtgccgagcgtcctggcgcggccgaggggaagcagcggggctgcccgggttacgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctgatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434034 - DNA, 3620 bp, Homo sapiens
tggcttcagcctcccaggctcaggagatcctaccatctcagcctcctgagtagctgggactacaggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434035 - DNA, 3583 bp, Homo sapiens
ggacgcgtgggtcgacccacgcgtccggactcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434036 - DNA, 3259 bp, Homo sapiens
tgtattggtggtgctctcagccgctctggcctgagcccctaggggtggaacacttcttgcgggagatgggacagttgtatgaggctgagagctgacctgaggaggcagggaggctgccggcaggccagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434037 - DNA, 2089 bp, Homo sapiens
taaggatagtaactacaatcccaaatagactctgtagcagcaatgactctccaaaaccacagaggtctagacctcctcactgctgagaaaggaggactttgcaccttcttaggggaagactgctgcttttacactaaccagtcagggatactaagagatgccacccggtgtttacaggaaaaggcttctgaaatcaggcaacacctttcaaactcttataccaacctctggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434038 - DNA, 1766 bp, Homo sapiens
cggccgcgcgggcgtggggggcgggcgggggcgccggcggaggacagcggtcccccgggatgcgggggtccgggtacgcgggcctaggggatccggggagggcgcgaggcccggaggtgcccggggcgcggcgggagcgagggcccggcgagcggctggggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggatagaagtggaattactgggcaaagggcattcagatttgggagaagtagccccagaaataaaagcatcagagagacgaacagctgtggccattgcagatttggaatggagagaaatggaaggagatgattgcgagttccgttatggaggtagaaactacaggatttggcaacagattggactggggagagggggagtgggtaaagtgacagataaccgggattttatatttagaacaattgggagaagttgccatcttggtgagaaagaagggttctaggtttagcttcaattaatttgtgtcagccaagggtgcattatttgattgacacttcattttccattgctttttccatagatggtacaaatgaggctcaggacaatgattttccaacaggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434039 - DNA, 833 bp, Homo sapiens
gcggccgcgcggaggaagcgaaggaggcgggagcggagacctcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacaggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434040 - DNA, 3567 bp, Homo sapiens
gcggccgcgcggaggaagcgaaggaggcgggagcggagacctcgctgcgctcatggcgtcgcccgggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttacccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434041 - DNA, 2899 bp, Homo sapiens
gcggccgcgcggaggaagcgaaggaggcgggagcggagacctcgctgcgctcatggcgtcgcccgggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcacgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcctgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgcacaagtgatggt

SEQ ID NO: 434042 - DNA, 909 bp, Homo sapiens
  misc_feature (814)..(814): n is a, c, g, or t
  misc_feature (818)..(818): n is a, c, g, or t
  misc_feature (824)..(824): n is a, c, g, or t
  misc_feature (832)..(832): n is a, c, g, or t
  misc_feature (834)..(834): n is a, c, g, or t
  misc_feature (836)..(836): n is a, c, g, or t
  misc_feature (845)..(845): n is a, c, g, or t
  misc_feature (853)..(853): n is a, c, g, or t
  misc_feature (864)..(864): n is a, c, g, or t
gtggtacgtcccgagctcggctgggcccaagatggcggcctccgtgtgcagcgggttgctggggccacggtgagtggggcgactcggcaggtccctgcgagtcggaggtggggtccctagtttccgcctcacgcgccctccctccacaggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttgaaaaaacacaaaaaaaaaaaaaacccgggggttttttgcgggggggggaaaaggggttngaangggccntgggtctngngnttctggccngtttttgncaagggggaantcgcgggtccccaaaagggggggataaattgaaaagccggtacta

SEQ ID NO: 434043 - DNA, 1567 bp, Homo sapiens
cggccgcgcgggcgtggggggcgggcgggggcgccggcggaggacagcggtcccccgggatgcgggggtccgggtacgcgggcctaggggatccggggagggcgcgaggcccggaggtgcccggggcgcggcgggagcgagggcccggcgagcggctggggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggatagaagtggaattactgggcaaagggcattcagatttgggagaagtagccccagaaataaaagcatcagagagacgaacagctgtggccattgcagatttggaatggagagaaatggaaggagatgattgcgagttccgttatggaggtagaaactacaggatttggcaacagattggactggggagagggggagtgggtaaagtgacagataaccgggattttatatttagaacaattgggagaagttgccatcttggtgagaaagaagggttctaggtttagcttcaattaatttgtgtcagccaagggtgcattatttgattgacacttcattttccattgctttttccatagatggtacaaatgaggctcaggacaatgattttccaacaggtgctgtcctggagccgagagctgccttgcgcttggcgcgccctgcacacctccccggtctgcgccaagaaccgggcggcccgagtacgcgtaagcaagggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434044 - DNA, 573 bp, Homo sapiens
gtggtacgtcccgagctcggctgggcccaagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaatacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434045 - DNA, 1297 bp, Homo sapiens
cggccgcgcgggcgtggggggcgggcgggggcgccggcggaggacagcggtcccccgggatgcgggggtccgggtacgcgggcctaggggatccggggagggcgcgaggcccggaggtgcccggggcgcggcgggagcgagggcccggcgagcggctggggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggatagaagtggaattactgggcaaagggcattcagatttgggagaagtagccccagaaataaaagcatcagagagacgaacagctgtggccattgcagatttggaatggagagaaatggaaggagatgattgcgagttccgttatggaggtagaaactacaggatttggcaacagattggactggggagagggggagtgggtaaagtgacagataaccgggattttatatttagaacaattgggagaagttgccatcttggtgagaaagaagggttctaggtttagcttcaattaatttgtgtcagccaagggtgcattatttgattgacacttcattttccattgctttttccatagatggtacaaatgaggctcaggacaatgattttccaacaggtaagcattttctctgccttttctctctgttctatgaaagggggttatcatctaggccagcagttcccacacctgactgtatcaaatcacctggggaggcagagcactcaggtttaggatgccctacttcattaacc

SEQ ID NO: 434046 - DNA, 348 bp, Homo sapiens
aaaaaaaaaaaaaatgagccggccatggtgacgctgagacaggagaatcacttgaacccaggaggcagaggttccagtgagctgagatcacgccactgcactccagcctgggggacagagcaagactccatctcagaaacaaacaaacacacaaagcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 434047 - DNA, 3065 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434048 - DNA, 2067 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctat

SEQ ID NO: 434049 - DNA, 1677 bp, Homo sapiens
caactacaagcaaacagcacaattaatgcaacattcagcaactccagaccagcttttcttacccccatgaagaacgatcaatttaaaaaacacagatctcaggtttcctcccaagctgtcagcgagcgctgctaccggtctagattgccatgtcccaacaacagcaaagccaccctccctcctgcttcttccaggattgctctttaaagggaccagagtgacatactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctat

SEQ ID NO: 434050 - DNA, 1218 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagcatcacaagcattcatcaacaagcagtcattgcacaagcagcccatcccatcttatagcattagcggtcagccatttacacaatgtgcaggcagcccaaaggcacctcgcggtttgttcttaatcattcattgcccatgcgacctgcaccagctttccatccaacaggtgcgcaccatgcagcacactcatttccaatattgcatcatctccatctctccaggcaagcatccgtcgaccacaagcgcattcccatgtggcaccacatatcagcagtcgcgcatcggttggtggatcatattcacctgctgttcacgaattgcacacccttgtgcttgtcgagcaccactcatccaccaaagcgctagacctcaggcaacccctgatcttcttctgcgcacaaaactaactactcgagcgacattggtccttggtgccaccaacagcaatcgtttctacagaatcctacttctcgaccacgacgaagcacacacttgcacacaaaccatgccagtctcactcttgcgcattgatcgccacttgcatgccctgggggcacatcacacggtggacgcagtgctgcacactcacagggattgtgacaataaccttgtgccaggctccagacgagctatgggctggccgcgcaagcagacagctcgtcccagcgaggggcagtcgccaatgggataccgcagcacgaacggcagcacatcgactgcattccaacgggctcttgaaagaagcttcccaaagggtcaattcagttggaatctcaccttggatgcacatgtacagacaccaataacatggcaacactggccagcccattgatggatgcgacacaactccaccacgtttggttaccctagtgcccatgaaatctgcgcaggaggacaacataggggagcgacagcgacacaggccaacggactcagcagacgccacgagccaacatcgaatggcgacaatgcacggacaca

SEQ ID NO: 434051 - DNA, 416 bp, Homo sapiens
acatttcattcacttctgggaaggggtcaactcctacctccataaacctacttcgtgtgtgcctgtgtgtatgtgagaaagaaacagactgtctctctctcttataattcttatttcttcatctttctttggaaaatttattcttctacccacctattaaaatggaaccttaaaacttcttttcagccattgcccttccccgtgggctaaagtaagtttcaccatcaaaaatttcctggggccagggatgtgagatggttctgagagaacaagttcttcagagttaggatgatagggtttgactgctggctttactgtttattgtgtgacctttgctgtttcctcacctgtaaaatgggagaaagtaacagtacctacttcataggagtgttgcgaggattaaatgaattatgtgt

SEQ ID NO: 434052 - DNA, 447 bp, Homo sapiens
  misc_feature (195)..(195): n is a, c, g, or t
  misc_feature (351)..(351): n is a, c, g, or t
ttggaggggccctgaggggctcctctttgtctctgcagggctgaggcaccggcgcgaggtggtgggcaaggagccccatcttcggcggggagcacttcatgctggaggagactgactggtacctgctgaacctcttccgcctctggtggcactatggcatcagcttcctgaggctgcagatgtgggtggaggagntcatggagaagttcatgaggtagggctggcagagctgtggggatggcgttccaggggaaccgagaagaggtgggggaggaaccagcttgcctgtactttgtgaaaaaggaaaaggtccttgctgaattgagccagcacaattcagtgcaggctcanagcaagcccctggcatgaggaatggccgtatttggtccagtagtggcctccctttccaacaatgtacataataaagtgtatgcactttcactaata

SEQ ID NO: 434053 - DNA, 3010 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggaatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434054 - DNA, 2992 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434055 - DNA, 2570 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434056 - DNA, 2974 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggataaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434057 - DNA, 3493 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaataaaaaaaaaaaaaaaaaaaaaaaaaaaaaataaaaaaaaaagaaaaaaaaaaaaaaaaaaaagacaaaaaaaataaacccagacagaaccaaaaacaagaaaacacgaggggggggcgcgcgccatcacgagatatccttcccagcgggggggccgcccataatggccgcgacgccccaacgccatatattgcgagacgccgagcggccggcccgcctactaagcgagtgcggccagtcttaaaatcaccggcaaccgggcgggccggcgccgataaaccacacaagcgggggagcgcacacacacacgactgcgccgggcgaccctgctgccaggagagacagcccaccccgtggtcggggagcgaacacaaccagggggacaaacagcacccgacacaacgacacacccgcgagtcggaggcaaata

SEQ ID NO: 434058 - DNA, 3156 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaataaatatttttggggtgagagtctgtttcggcctgtattgaatgtctgtggatttccgttttcagaagtagtacattagatcctccggttctg

SEQ ID NO: 434059 - DNA, 3145 bp, Homo sapiens
  misc_feature (3071)..(3071): n is a, c, g, or t
  misc_feature (3075)..(3075): n is a, c, g, or t
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaataccttcnaaanaaagggaaaaccaacttatttttttaacccctcgggggggggggccgcgggacccaaatttggcccttat

SEQ ID NO: 434060 - DNA, 1601 bp, Homo sapiens
gcggccgtcgcgatctagaactagttccctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434061 - DNA, 2949 bp, Homo sapiens
  misc_feature (2931)..(2931): n is a, c, g, or t
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcctcatgancgggtcctcgagatcgac

SEQ ID NO: 434062 - DNA, 2998 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgattactccagaggaacatacagaaacaatccatgtttagctctccgctggttcttccagtggtttgagacactg

SEQ ID NO: 434063 - DNA, 3011 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactggtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434064 - DNA, 2854 bp, Homo sapiens
  misc_feature (2829)..(2829): n is a, c, g, or t
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgtggcngcgacacggatcctctagatcacct

SEQ ID NO: 434065 - DNA, 1267 bp, Homo sapiens
gatcccattgctaatacattccgaaggcaatattctgcatctattaacccccaattcccagtctctcccactccctcctcaggtgacccagtgacaccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 434066 - DNA, 1404 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagactgggcaacgagagtgaaaatccgtctcaaaaaaaaa

SEQ ID NO: 434067 - DNA, 909 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagactgggcaacgagagtgaaaatccgtctcaaaaaaaaa

SEQ ID NO: 434068 - DNA, 1271 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggtaactttttttttaaacttgtttttcttactgagttttctcttttattaataattataaaaaaacgtaaaacatgcttgctgtaaaaacttgaaataatcttgaagtggtaaagttagaagtgaaaaccctccccgtaacttcaaatcatattcccccagaggtcaccactcctaacagttgagtgtatttggattttatttgaccaggtttttggattactggcttgtttgttttacaaaagtagggttatactgcacatgttgttctgcgctctgcttttttcatttaatattaatatctatggacgtatcagtacatgtagagttacctcattcttttatgactgtgtgtaccatacttattctcccgattccatattaaggtcaaattaacagttccaacttcggagcaagtgggtcatcattccatccataccacccatctcttacttatttttggcttcttttttgttctgtttcttttctcaggctctttttcccttttactgtttcctattcctcattctctcttttcctc

SEQ ID NO: 434069 - DNA, 695 bp, Homo sapiens
agcggagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagcatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctat

SEQ ID NO: 434070 - DNA, 273 bp, Homo sapiens
tttagagcagaaatatatatttaagaagccatgcatgtatatatttgtactcttcatgttaaattattattcatgtttttattctagattataaaagagtatgaaagagccatcatctttagattgggtcgcattttacaaggaggagccaaaggacctggtcagtactgggattctagattgtttatctgaaaactaaagttctttttattttttttatttttaggtagttgtttttttaaagacagggtttcattccgtcgcccaggctgg

SEQ ID NO: 434071 - DNA, 2108 bp, Homo sapiens
tcctgtcttcttgtcttgctagatcggggcagcagtgcttagggcgggcctcagaggctcacacacgtatcgccaggggagaaccagctctctccggcttggactcggggcggctccccgcctgcagccccggaagcgcatcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaa

SEQ ID NO: 434072 - DNA, 2135 bp, Homo sapiens
tcctgtcttcttgtcttgctagatcggggcagcagtgcttagggcgggcctcagaggctcacacacgtatcgccaggggagaaccagctctctccggcttggactcggggcggctccccgcctgcagccccggaagcgcatcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaagaaaaaaaaaaaaaaaaaatttggggg

SEQ ID NO: 434073 - DNA, 2039 bp, Homo sapiens
tcctgtcttcttgtcttgctagatcggggcagcagtgcttagggcgggcctcagaggctcacacacgtatcgccaggggagaaccagctctctccggcttggactcggggcggctccccgcctgcagccccggaagcgcatcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatcagacacgtatgggatcctctggaacactaa

SEQ ID NO: 434074 - DNA, 1844 bp, Homo sapiens
gaaacaattttggagtgagatggaaggagaatgacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaa

SEQ ID NO: 434075 - DNA, 2234 bp, Homo sapiens
tcctgtcttcttgtcttgctagatcggggcagcagtgcttagggcgggcctcagaggctcacacacgtatcgccaggggagaaccagctctctccggcttggactcggggcggctccccgcctgcagccccggaagcgcatcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggaaatataagcaagttattatggtgcccagaaagggggaaaaggttccagagtcctaggagatgacaaggatttatcctcttcatctttctccgatcccagttagcaggaatactttagcctggaagacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaa

SEQ ID NO: 434076 - DNA, 1472 bp, Homo sapiens
ggaaagctatgacaggaacaggtatacaggaaacagctagtactgtaaaagtctatagtaggaaaagtatttaacgagaacaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaa

SEQ ID NO: 434077 - DNA, 1797 bp, Homo sapiens
tcctgtcttcttgtcttgctagatcggggcagcagtgcttagggcgggcctcagaggctcacacacgtatcgccaggggagaaccagctctctccggcttggactcggggcggctccccgcctgcagccccggaagcgcatcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaa

SEQ ID NO: 434078 - DNA, 2422 bp, Homo sapiens
cacgcgtccggctagaaacattcttgtggagatctcctgtccacacctccaagaatccctctaagtaaacacctagaagtaaaattgctttacacaataccactgtttgcagagtgctttacaaataaccactgtttccaaaagcaaatacactaattggcacacacacacagcagtacataagggttttgattgctccatatcagctgagcccttgatattgtcagacaacttggttttcctcagtttgatagatatgaaatgttatatcctatgcttttaatatgtacttcttatatatttttaggtgcttattcctcactcatgcttccaagaagtacctgttaacattttttgccatagttttaaaattttcattttgtcctttcctcatggatctataggaatgctttatgtattcaggattctaacattttgtccattatatattttacatatatctttgccaagctggtacttattgttttacttttattatgctatcttttttgatatacacgaattattaacaatatagtcaatttgatttttaacgtttacattggtcagtctttccctttatggtttacgctttttgtgtcttgttaaagacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaa

SEQ ID NO: 434079 - DNA, 3522 bp, Homo sapiens
  misc_feature (170)..(170): n is a, c, g, or t
cgcggggggtgggcgcagctcgtcgcgctccgcacaaagtttgttttctccctccgggcgggtgggggagggcgcagagggcgcggggggaggagaggggatctgacgtcaggccgcgaggtgctttccacgccgcgagctgtcaggccgagtgtcaggccgggcaggtncgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcaga

SEQ ID NO: 434080 - DNA, 3429 bp, Homo sapiens
cgcggggggtgggcgcagctcgtcgcgctccgcacaaagtttgttttctccctccgggcgggtgggggagggcgcagagggcgcggggggaggagaggggatctgacgtcaggccgcgaggtgctttccacgccgcgagctgtcaggccgagtgtcaggccgggcaggtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcaga

SEQ ID NO: 434081 - DNA, 3362 bp, Homo sapiens
aacagtatcttgttctatatgcctagactggaatccagtggtgcgatcatagctcattgcaggctccacctcttgggctccagctatcttccgatctcaggctcccaagtagttgggaccacaggggtgcaccactacacctggctaacttcttttgtagaaacagggtctccctgtgttgcccaggctggtcttgaactcctgggcttaagcaatcctcccgccttggccacccaaagtgttgggattacaggtgtgagccactgtgcccagcccatagctgttttagattaagcaaattgatcggtcttgtatattcattccagatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcaga

SEQ ID NO: 434082 - DNA, 3735 bp, Homo sapiens
  misc_feature (170)..(170): n is a, c, g, or t
cgcggggggtgggcgcagctcgtcgcgctccgcacaaagtttgttttctccctccgggcgggtgggggagggcgcagagggcgcggggggaggagaggggatctgacgtcaggccgcgaggtgctttccacgccgcgagctgtcaggccgagtgtcaggccgggcaggtncgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaacagggttcttgattgatccaccagggctcagggcccaggcttgaagacaaagcagtcactggcttcttattttgctttacatcttttactctccctctagtagccagctgtgagttctgtgcacgctgtacccccattccctttcaccagctccattctgtatcccattcaactcagggtaaagggggcatttgcatctcacattgggcca

SEQ ID NO: 434083 - DNA, 2876 bp, Homo sapiens
  misc_feature (170)..(170): n is a, c, g, or t
cgcggggggtgggcgcagctcgtcgcgctccgcacaaagtttgttttctccctccgggcgggtgggggagggcgcagagggcgcggggggaggagaggggatctgacgtcaggccgcgaggtgctttccacgccgcgagctgtcaggccgagtgtcaggccgggcaggtncgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcaga

SEQ ID NO: 434084 - DNA, 2164 bp, Homo sapiens
gctgtggtttgcattcacggcagtagttagcccaggtgtggggaacgagagtgcactgcatgatagcgttctggtgagctgggaaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcaga

SEQ ID NO: 434085 - DNA, 3234 bp, Homo sapiens
  misc_feature (170)..(170): n is a, c, g, or t
cgcggggggtgggcgcagctcgtcgcgctccgcacaaagtttgttttctccctccgggcgggtgggggagggcgcagagggcgcggggggaggagaggggatctgacgtcaggccgcgaggtgctttccacgccgcgagctgtcaggccgagtgtcaggccgggcaggtncgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagttgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcaga

SEQ ID NO: 434086 - DNA, 2859 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434087 - DNA, 761 bp, Homo sapiens
  misc_feature (41)..(41): n is a, c, g, or t
  misc_feature (54)..(54): n is a, c, g, or t
  misc_feature (67)..(67): n is a, c, g, or t
  misc_feature (194)..(194): n is a, c, g, or t
gttctgaggtccccgtacggagcaagtgtctctgatggaangtgtctctgatgnagaggtctctggnatgcaaagtgtctctggatgcaaagtgtctctggatgcaaagtgtctctggatgcaaaggcctctggatgcaaagtgtctctggatgcaaagtgtctctggatgcaaagtgtctctggatgcaaagngtctctggatgcaaagtgtcctctggatgcaaagtgtcctctggatgcaaagtgtcctctggatgcaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacatccagaggggtaccgagct

SEQ ID NO: 434088 - DNA, 817 bp, Homo sapiens
cggacgcgtgggtcgacccacgcgtccgccacgcgtcgctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcaaaaaagaacatatatgtaaaggaagcagagttgaagtaaaaagggtggccaagacccatgcagggtgcgaggaaacatggaaccaacccacgacgggcgagtccaggtggaggcaccatggctgggttacacccagaaaggtgggcacaccatcttgggcagcaatttacacgaagcgccttgagggtcgagccaacacgagcaacacggggacaaagcagttggcagtagggagcacgggaaagacacgtactcggggaaagggactagaggcaccacggcaagcgaggacaccgagcgcgacaaaag

SEQ ID NO: 434089 - DNA, 2918 bp, Homo sapiens
aattcccctttcactgttgccctactgttaaagttcttcccgcctcgggaatccctggacggcggcggcggagcgggagggaagccgcccctggggactgagcgctgcggtcccggctatgggaggaggcaactttcagggcaggtgtcccgcgggaagggtagcatcattcagggtggccgcccggtcctgcctgcgggagtaggaggaccgagacgtccggctttcttcccgcatgcaggtgttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434090 - DNA, 2815 bp, Homo sapiens
aattcccctttcactgttgccctactgttaaagttcttcccgcctcgggaatccctggacggcggcggcggagcgggagggaagccgcccctggggactgagcgctgcggtcccggctatgggaggaggcaactttcagggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434091 - DNA, 2738 bp, Homo sapiens
gggccgcggagacgtgaagctctcgaggctcctcccgctgcggtcggcgctcgcctcgctctcgttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434092 - DNA, 2757 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434093 - DNA, 2655 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434094 - DNA, 2226 bp, Homo sapiens
  misc_feature (14)..(14): n is a, c, g, or t
tatttggtcccccncgagtattggatatcgtcgaccacggccctcggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434095 - DNA, 1961 bp, Homo sapiens
  misc_feature (49)..(50): n is a, c, g, or t
agtggtgatgttggggtggggagggggcagggtgaaatgttgaggaagnngtttcagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434096 - DNA, 3016 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcacaaaaaaaaaccacacagatcagcaccgccccacaccccttggtccggcaccgcctggggccctcccgaaaaagtcctcctgagaacccacgcctggagcgcggcgggccccacaaggatccggcgcaactgcgcccaacaggggctcccagcgccc

SEQ ID NO: 434097 - DNA, 2926 bp, Homo sapiens
  misc_feature (2867)..(2867): n is a, c, g, or t
  misc_feature (2880)..(2880): n is a, c, g, or t
  misc_feature (2896)..(2896): n is a, c, g, or t
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcaaaaaaaanttggttccacctntgcaggtttttataantggtgccaattaaaggtttttgtttttaaa

SEQ ID NO: 434098 - DNA, 2903 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcatcccaaaaacatctcccaacaaacgaacaaaaccaaaataacca

SEQ ID NO: 434099 - DNA, 2815 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgttcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434100 - DNA, 2653 bp, Homo sapiens
  misc_feature (2619)..(2619): n is a, c, g, or t
  misc_feature (2627)..(2627): n is a, c, g, or t
  misc_feature (2629)..(2631): n is a, c, g, or t
  misc_feature (2635)..(2635): n is a, c, g, or t
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgatntgcatccngnnnggancctctgaacgctatcacg

SEQ ID NO: 434101 - DNA, 2862 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgaagcaagcttctgttgaaaagacccagtgctcccccaccccggtgtccagcggctgacgaaggggccgcgaactgtgttggtggtaccaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434102 - DNA, 2638 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacatccagaggggtaccgagct

SEQ ID NO: 434103 - DNA, 2634 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttatctatatgaattatcccacaggctctctaaacacgatacctagcatcccgagcgttgt

SEQ ID NO: 434104 - DNA, 2602 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagactcatggttatctgtaaaatctcagcgggtctggtatcactcttgactatatgtgaacttccaggac

SEQ ID NO: 434105 - DNA, 2807 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcactcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434106 - DNA, 2609 bp, Homo sapiens
  misc_feature (2575)..(2575): n is a, c, g, or t
  misc_feature (2583)..(2583): n is a, c, g, or t
  misc_feature (2585)..(2587): n is a, c, g, or t
  misc_feature (2591)..(2591): n is a, c, g, or t
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgttcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgatntgcatccngnnnggancctctgaacgctatcacg

SEQ ID NO: 434107 - DNA, 2125 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaacttgggaacctctagaatcagccc

SEQ ID NO: 434108 - DNA, 2202 bp, Homo sapiens
  misc_feature (2108)..(2108): n is a, c, g, or t
  misc_feature (2111)..(2111): n is a, c, g, or t
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaacaaggtngtnatcccaattccgccccccttttaggtatataaactccttggtaaaaagtggtcctggtagggttacggtttttattatttattaataagcg

SEQ ID NO: 434109 - DNA, 982 bp, Homo sapiens
  misc_feature (41)..(41): n is a, c, g, or t
  misc_feature (54)..(54): n is a, c, g, or t
  misc_feature (67)..(67): n is a, c, g, or t
  misc_feature (194)..(194): n is a, c, g, or t
gttctgaggtccccgtacggagcaagtgtctctgatggaangtgtctctgatgnagaggtctctggnatgcaaagtgtctctggatgcaaagtgtctctggatgcaaagtgtctctggatgcaaaggcctctggatgcaaagtgtctctggatgcaaagtgtctctggatgcaaagtgtctctggatgcaaagngtctctggatgcaaagtgtcctctggatgcaaagtgtcctctggatgcaaagtgtcctctggatgcaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434110 - DNA, 656 bp, Homo sapiens
  misc_feature (17)..(17): n is a, c, g, or t
gaggtgatctagaggantccgggagtagtcaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434111 - DNA, 1808 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagct

SEQ ID NO: 434112 - DNA, 1926 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagaaaatatctgcagatattttctatgcctttttatagtaatatattaataacattaataactatgaccaatagttcaattaaaaaaatactttagataattttgagagtgctcacagtaagaaaactctgaggtcttgtaataaacagctataaaaatgtttcctctaagatctgattaaaatttggattattgctcttttgctttggtaaatgtataacaacattctaatttctactccttaagtaatgatttctagcaccacccagaataaaatagcttcaacagctaatctttacatagaaaatatctgggggatcctaag

SEQ ID NO: 434113 - DNA, 1604 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagaggtaaatatttcagtctttcaagtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacga

SEQ ID NO: 434114 - DNA, 1342 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaagaaaagagtctcatcgtggaaggcaagagggaaaagaaaaaagtagagaggttgacaatgcaagtctcttccttacagagagagccatttacaattgcacaag

SEQ ID NO: 434115 - DNA, 1295 bp, Homo sapiens
cattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttaataaataacagaggcataagtgattggccgggctggattatttccctgggaaaactcaccaaaatcacaacgctgctaccttggaaaatactctgacatccagcccaagtctgccttgaacttgctatgacgagctgcacctcagattccctactttacaacatggcacgcgacatcgccag

SEQ ID NO: 434116 - DNA, 508 bp, Homo sapiens
cggacgcgtgggtcgacccacgcgtccgccacgcgtcgctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434117 - DNA, 463 bp, Homo sapiens
gtttattaaatctgatttaagacagtaaatttgaaagacaaaattaagtctcattcaggagtggtccattatgttgatcatctagaatcaacactgattaaccaaactctgaaagccaagagccccaactccagagaaacataattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 434118 - DNA, 441 bp, Homo sapiens
tttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcacactggtgttttaagtcacttgcatttgatatcttataggtgtatatagcatttccttatggggaataattctgaaaagggatttttaaattgattcagccctataacctatacaatttggaa

SEQ ID NO: 434119 - DNA, 3342 bp, Homo sapiens
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcagggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacactggaggaaaatgctcattagagcttttcaggttttggattttcggatttgggatacttgactagtaaatataatacagatattccaaaacacacaaaaaaaccaaagtctaaaagacttctggtcccaagcatttcagataagggatacccaacctgtaataatgggaaacaagcagtagaggctgttggttaatcttggcacaagtttaattacaggttttttttttttcctgtttcttaagtacagtcaaacataaacttactggaggaaacatttataaaaataaatatactttcatttgaatagct

SEQ ID NO: 434120 - DNA, 2598 bp, Homo sapiens
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434121 - DNA, 752 bp, Homo sapiens
  misc_feature (23)..(23): n is a, c, g, or t
  misc_feature (738)..(738): n is a, c, g, or t
  misc_feature (740)..(740): n is a, c, g, or t
tgacatgatacgactcgagtctnagacccgggagtagtccaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactacccccgggtcnanctcgagtcgtat

SEQ ID NO: 434122 - DNA, 1429 bp, Homo sapiens
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccaccttccctctgagctacagaggtacatatccaccagtctactcggcttctccacttggatgtctaatagcacatcctgtttaatgtgtctacatcagaacttctgatccagctccccacctgcaccccacctgccagggtctccatttcagctgaagccttgttgttgctcactcggctgtctaggcttagagcgcaggagccatccttgtttcctctcctctccacttcatgcctcgtcatccagtccatcagctgtttgcagattttgttccacatccagccatttctcagtgcttcccttccatcaggcctctggattactgtaatactggataactgatctttctgcttctgcttttgtctctcttgtaacctattttccatgtaacagccagactgatgtaaaatattaaaaatataaac

SEQ ID NO: 434123 - DNA, 232 bp, Homo sapiens
catgaaaaccaggctggggttttcatgtttaaagccgtggggaaaggacaatgtttccagggagcaacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434124 - DNA, 364 bp, Homo sapiens
ccatgcccagctaattttgtgtttttagtagagatggggtttctccatgttggtcaggctggtctcaagctccctacctcaggtgacccacccgccttgtcctcccaaagtgctgggattacaggtgtgagccaccatgcccggccaggattatttaaatgtgttcccaagtgaaagagggaactgatcattgagggtaccatgagagtgctctatgttatgacatgctggtgccatgtaaatgaagggcgtttgtttcaagtctttaattagtatgtaaggtttgcagaaaagctatcaggatacaggaaggcattaaggagccgatggagtgttttcattcttaatcccagtggagtgtgtg

SEQ ID NO: 434125 - DNA, 2523 bp, Homo sapiens
ggcagtgaatcggtatcagggtcatagtcgttccagaggatccccgtcgtccagttatcatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434126 - DNA, 1516 bp, Homo sapiens
tgtgcgggggcgtttcatcagccactcctggcgtctatattcgaaaccacccaaatctagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434127 - DNA, 2523 bp, Homo sapiens
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaacca

SEQ ID NO: 434128 - DNA, 2372 bp, Homo sapiens
  misc_feature (2358)..(2358): n is a, c, g, or t
  misc_feature (2360)..(2360): n is a, c, g, or t
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactacccccgggtcnanctcgagtcgtat

SEQ ID NO: 434129 - DNA, 1816 bp, Homo sapiens
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagctcttactgcccaggctggagtagctcttctgcagcgggtccccaggttacc

SEQ ID NO: 434130 - DNA, 545 bp, Homo sapiens
gtgccatgtaaatgaagggcgtttgtttcaagtctttaattagtatgtaaggtttgcagaaaagctatcaggatacaggaaggcattaaggagccgatggagtgttttcattcttaatcccagtggagtgtgtgtgcatggacatgtgtgtttagatacagaaagtgagagagaggtaagggttttccttggtttgccagttttttagcgataatgaagtaaacacctaactagaaacctaagcaaactaatttttttgttttattttcagattgtcttcttacataatgatagatacattgaatttcattcgcaatcaggtttttactacaaaaccagaataccaaagtttgggagagatttctcttaccactatccatcctgtgacttgtactttgttggtgcaaggtattggatccagtccctttttctccttttcacctcctaaaacaaccaacttctgttcctaaatttcgtgtacattttctctgtttaggtaacttgctttaataaaaaagtgatacgtggctcttgtaaaaaaaaaa

SEQ ID NO: 434131 - DNA, 2461 bp, Homo sapiens
ggcacggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434132 - DNA, 1514 bp, Homo sapiens
ccctccctctttcatccctcctcttactgtttctcttctcctaatagaggagattccgttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434133 - DNA, 978 bp, Homo sapiens
  misc_feature (23)..(23): n is a, c, g, or t
tgacatgatacgactcgagtctnagacccgggagtagtccaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 434134 - DNA, 1610 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatcctttta

SEQ ID NO: 434135 - DNA, 2695 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434136 - DNA, 2744 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaag

SEQ ID NO: 434137 - DNA, 3402 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatgaggcgtgtggccagagggagagggctggccctgccatcactagaacacaggccgtcctgttcatatgatgcactgccacttccgttttgtgaaaccaggaatcctgaggctcatctttattttttcagaacagacgtagagagatgaaggcttgtggaggaaaagatggtgagagacttgggcagaaaatgagtagtcctcaggaagaaatcttggttatgtgtttagagcatgaaggacagagccatatagtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434138 - DNA, 2836 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434139 - DNA, 2635 bp, Homo sapiens
aatggtaccaggagcctgggcctctgttgctgaaaggtcctggaccttttacctctaaaatttcatgatacttattttaacatgaaaagcctttattgaattgtgcattctttaatccccaccccttttgcctttcagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434140 - DNA, 2754 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgataaaaaaaaaacccccccaaaaagaaaggggggcgttttttttttttttttgggggaacctttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434141 - DNA, 2507 bp, Homo sapiens
ctatttccttttgtctttccagctcccgatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434142 - DNA, 2379 bp, Homo sapiens
tgaaggctcctgctcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434143 - DNA, 3348 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatgaggcgtgtggccagagggagagggctggccctgccatcactagaacacaggccgtcctgttcatatgatgcactgccacttccgttttgtgaaaccaggaatcctgaggctcatctttattttttcagaacagacgtagagagatgaaggcttgtggaggaaaagatggtgagagacttgggcagaaaatgagtagtcctcaggaagaaatcttggttatgtgtttagagcatgaaggacagagccatatagtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434144 - DNA, 2638 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaataccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434145 - DNA, 1556 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaagatatatgttgattgatcccttttttattttgtggttttttaatatagtataaaaatcctttta

SEQ ID NO: 434146 - DNA, 2311 bp, Homo sapiens
ctctagcggatccttacctaaatggctgtcaggttactgcaggagtcaaaagatggccagattgtatctccttagaacatacagaacatctttccggcaagaatattcattcaagaagattttaaagggtgaataacatttcagtaagatataaaaaagacgtttgaggagatagaaatagcaaaaggaaagttagaatcaggaaagtagcgtcctccctctgtggttttaaaaaaagtcgtataaaggctgtaaaattgatttggtgtttttctctccttgtggtaaaccaaaaagtaggttaaatttgttcaagataaataattgatacaagtgaggtttcagagtgttttctatagtattttggtgagcctactttatttttctccaatagtaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434147 - DNA, 1751 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatcctttta

SEQ ID NO: 434148 - DNA, 1270 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaacgtggatgaagtgactgcttggatacaacgactgcttgttaacaaggaggtccgagctcga

SEQ ID NO: 434149 - DNA, 2528 bp, Homo sapiens
tctttgatgtttataacacaagttgtaattggcacattacaaaacattttctacaaacaggacagggtatgctataagtaacattcttactgcagaagatgacaggcgttggttatttgtacttctcttgctcaattattacagttttaaacataaagacaatgatttcaagttttatttgatgaagaaacaggaatgcttcatgattgaggatcagtatgatgactgaagaccttgattctagcgtgctcagtagtttagttccttagacatgcctttggtttcagtcatttggtgagtatttagtgcctctcacatgcactgcactgtgcggagagcacttggattacaggaagcatgctctgtactctcagtggtgtgttcagttgaagaaacacataaaataactgaaagatattcagttactagactaggtagtattgactaagttcaggagttgagaaaaggattagatcagtgaaaaaatagactgccttgtgagcaatagcagatatgggctgcgctttgaaacgaacaggtgggatttgcagggaagggtattctgattgggataatggctcgtaggagacagtgaagatcaggactaccaaaatggaatggatgggcctgttggggattagcagaagtgcttaggtgggtggaattacagagggctaggaaagctagacagagctagtcaaaatgagacctgatgtgaaaggccactagggcaccagcctttttaatctgaaagctctgcttcctctgtttctttatcctgttgctgtttgttgaccacataattatttgtttacgtcatcagctggcacagggcctttatgaggtcagagactgcctagccctgtgttcctggcacctaacaatgcctgtcataaaaacaggcattcagtacgtttttgatgatgaacaaattatacttatttccttggtatttgacaactacttgactgtatatgatgataattagaatatccactctgagaaatcatttaaaagagaaaactcattcaatgcaatctcaaatgcctttactcatcacgctctcattttcttccagattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434150 - DNA, 1990 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatgaggcgtgtggccagagggagagggctggccctgccatcactagaacacaggccgtcctgttcatatgatgcactgccacttccgttttgtgaaaccaggaatcctgaggctcatctttattttttcagaacagacgtagagagatgaaggcttgtggaggaaaagatggtgagagacttgggcagaaaatgagtagtcctcaggaagaaatcttggttatgtgtttagagcatgaaggacagagccatatagtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacaggtgagtgccagaaaccaacagttgtcccgacttgtgaggttatctgaagtaaggcagccggtggctggattagtaactgcatattcccctgggcccgtgaccttgaacgtttgctccaagtcaactcacctataggaattatcactcacatgccctgtcagccctttgggaagtgagatgagcaaaaattgcaagtaatggtggaggctca

SEQ ID NO: 434151 - DNA, 2669 bp, Homo sapiens
tctttgatgtttataacacaagttgtaattggcacattacaaaacattttctacaaacaggacagggtatgctataagtaacattcttactgcagaagatgacaggcgttggttatttgtacttctcttgctcaattattacagttttaaacataaagacaatgatttcaagttttatttgatgaagaaacaggaatgcttcatgattgaggatcagtatgatgactgaagaccttgattctagcgtgctcagtagtttagttccttagacatgcctttggtttcagtcatttggtgagtatttagtgcctctcacatgcactgcactgtgcggagagcacttggattacaggaagcatgctctgtactctcagtggtgtgttcagttgaagaaacacataaaataactgaaagatattcagttactagactaggtagtattgactaagttcaggagttgagaaaaggattagatcagtgaaaaaatagactgccttgtgagcaatagcagatatgggctgcgctttgaaacgaacaggtgggatttgcagggaagggtattctgattgggataatggctcgtaggagacagtgaagatcaggactaccaaaatggaatggatgggcctgttggggattagcagaagtgcttaggtgggtggaattacagagggctaggaaagctagacagagctagtcaaaatgagacctgatgtgaaaggccactagggcaccagcctttttaatctgaaagctctgcttcctctgtttctttatcctgttgctgtttgttgaccacataattatttgtttacgtcatcagctggcacagggcctttatgaggtcagagactgcctagccctgtgttcctggcacctaacaatgcctgtcataaaaacaggcattcagtacgtttttgatgatgaacaaattatacttatttccttggtatttgacaactacttgactgtatatgatgataattagaatatccactctgagaaatcatttaaaagagaaaactcattcaatgcaatctcaaatgcctttactcatcacgctctcattttcttccagattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434152 - DNA, 1836 bp, Homo sapiens
actcagttctgtaacacatctaatgatatgctgctcagttctgtaacacatctaatggtatgttttgatacaatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacatttta

SEQ ID NO: 434153 - DNA, 1500 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtaaggcatgaacaaatatgtcttaaacatatataaatactggaagtgcaattccactatgtgctttttcttttcagtttgataaatagttcatttgacattgatttgggtaattttctttctggaatcccagcaatacacatttgcgtcacagttttaatttatattgggttttcatatgtattttcctttgagcttcacaaccactttctaacatttatttattggatactttgggactagcttaaaatctattcctgcactgtctttacctgcagcacagtccagttggccgatgctgaatccactctgttgtttctcttaggggggaagcatagttaacattgagtgtgtctgttttgggcattgtgacacatttcatatccgctatcttagttaatccccaaatgtttggtttttattaacttcttttggaattcagtatataggttgaatatttgtaggtctcatttttccagcttataaattgactgccctttttaataaggaggcatgctttccatactaaggacatttgtttttttttcttaaacaccagcaggaactagatagctttgaatgagaagactttgtttgaccttgtagctcatgatagggaggtagtggcatgcccatcatatgtatagttgttgacagattgatgttcttattttaatgtgattagtagcagatttccagtaatcaccctgaatttttttaactgaacttattagagctaatctgcttttcagaatcagtaatcactctaggtcctagtg

SEQ ID NO: 434154 - DNA, 1835 bp, Homo sapiens
gcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagcacacacaggcaacatcagcacagcaacagggcaacacacacaggcgtcaacagcacagcaccatgcacagcacaagctgggagtattgcaaaggcagcaccgagcatccaagcattcatgcaatgcacaggcatgcaaagcatctcattgccagcgcagcagcagagagggcaacacagcaagtcatcggggcgcgcagcatgccacatttgcacccacacccacacattcctctgggttagccagccccaagcacaacaagcagcttcaccccccagcaggcattatttaccctctcatgcgcaaagccaggcacatcacaacgaacacttcgaatccacgagattcgtttcaccaaaccagcacagcccacgttaccaatcccccacaggatggtaccgaacggcacaccaaaggaccaacggaccccgcagcaatcgtccacacatcccggggaaccctacagcgccaaacacttccccctctccccgtacggccatacaaccaatgcgcggcgagacgcccacccgggagccgcgaccggccaccaacaggaactccaattggcgcacgaacacgatcaccaggggcactttcccccgcggacaggcggccaccaaaggggactccatcgcgaggaggacaccggcacatttggcacagcacaggcgggacagttgacaggacaacctctaggacctctggatcacaaagacaggggacacgcacacagaaccacaacgcagcagaccgttgcgcagggcagcaagaaacacaataaggccagcagggaccagaacacagaccacacacacgagaaacgaacaaaaaggacagggcaaaatcacccaacggaaaaggacgttacacagcacatccagaacgactacacgaagcgaacaatcgcagcaaaccgtcacggagtagcacccacaccgccaacgggtggcccaaccacaccacagcggacaacacgaggcagagacgcgcggacaccaaggtcgcaggtccacaacactcgggcagacgcggacacagcaggaaccgcaggcgagcccaccactcgcacaacagacgaacaacgcacgctgagaccatctcaagcagacgtgctggaagcacagccagcagagacgcaagcacaccaagcgcaccacctagacaccagacacgaccgtcaacacacagccaacaagccgagagaacaacacgagcgagccacaaacgaccgcacgaca

SEQ ID NO: 434155 - DNA, 419 bp, Homo sapiens
gtcaccccagcctaccctgctccccctaaaagttaaaactgaaaatgatacttttgcaaataatactttgggcagatcccacgtaaggctgattttagatttttcactaatgtgtaagtctctttgctaagtacagtgtttaagactgcagtgagtaattaaatatttgaaattgctagagcttcagatagtttatacattttggtgcttgcatagatgcttttgtaactctttacaggcttaatatatgttttagtgttttaagaaatactaacttttgggtactttggggatgaaatttttcattatgtcgtttgggattgagaacatttaccatcactaagtcatatttatatacctctgctaggtgtttgtaagttatacttggtacttgaatttgtttatttttgtgtttaaag

SEQ ID NO: 434156 - DNA, 1173 bp, Homo sapiens
  misc_feature (1)..(1): n is a, c, g, or t
  misc_feature (7)..(7): n is a, c, g, or t
ngacgangcccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttccctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacagatgaagaatacttgcaggcttatggtgggcaacaagggctgcaagagcaggaagactgtgtggctgaagatgaattagatgagattactgatgcccaggttgctcctgcaactgaagagggaggtatggaaacattggaactttaaaaggaccctcgtgccgcctcgtgcc

SEQ ID NO: 434157 - DNA, 3622 bp, Homo sapiens
  misc_feature (1)..(1): n is a, c, g, or t
  misc_feature (7)..(7): n is a, c, g, or t
ngacgangcccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttccctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgatacttccagaggaggaattaatgagcgacctgatgccctaagatgacataagctgttggaccttgctacctaaagcctctagagagccccaggctccccctccaccgcctccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtggggtaagttgacaagttttatgagagcctctttgagtctgtgtatcacatagaatgtcctcatttgcagagaatgtttttgaagaaagaattaaaagttacctctgttatagtcttgtaaccaa

SEQ ID NO: 434158 - DNA, 1894 bp, Homo sapiens
tgtcagtcgctctgggaagcagccgagactgcgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtggggtaagttgacaagttttatgagagcctctttgagtctgtgtatcacatagaatgtcctcatttgcagagaatgtttttgaagaaagaattaaaagttacctctgttatagtcttgtaaccaa

SEQ ID NO: 434159 - DNA, 967 bp, Homo sapiens
  misc_feature (1)..(1): n is a, c, g, or t
  misc_feature (7)..(7): n is a, c, g, or t
ngacgangcccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttccctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacaggtacgtgcaccctgtgcttcacctaactgcctgtgccgatctctctcattctgacacttggctcctgagggatctttactgaacgcagcaccttgactacctggcgctctctcttgagtggggctgtccctcctgagctaaagtgaagcttctccatgcagaaggctgaggtgtgctcctgttccaggcctgtgttgtgtggagggctgccaatagatcataggtcttctgtcctttttctttgtttttgtacagtaatgatactgactttgtggacacccagaaccattactggagtggccttgtgccagagttctttaagctctactttgtactgaatatctggctacactttaacgttttttccattctaatatgtgtagatggtatttcactaattttaactttcat

SEQ ID NO: 434160 - DNA, 513 bp, Homo sapiens
agcggaggagcaggcgccggaggtacgtgaggcagccggactctgggggccaggaccgcgccgcggtgggcgggggtgtaggccggggggcctccccgcttaggagaggacgaggctctccccggctccgactctctttgtgttcggcctattccgttttctccctcgccttccctcgctattgtcattctccctttctcgctcctcctctccgctgtgcagatcgtacttacctgtgaacttctgtgtgtcctctactttgcaaggctgcctaagtgtcaggcccatctctggcgttggcgggcattaagtgccgaagccggcctggtgtcctatgggtaggagagcgccccccccaccccccgagacagtgtcacttagggagagcggggcaggtcgctgtagggtgggtgtttaagattgtggggccatcctgacagatttagattgatttgaagcccattacaaaaacataacgaaaagattcacctgtgtgaaggaatgtgcgacagt

SEQ ID NO: 434161 - DNA, 463 bp, Homo sapiens
ttgacatgtctcttttttttctcccaagtgaacttgaagatgatttacttggagaagatttgctatctggcaaaaaggtaagaagtttatgtccttctgagatgaaatactagtcatttaattatacttaacatacagcagtaatcacttatacatgggtttcattactggaaagttgggtatagattaaaattttgtaaactgaattattttttaagtgcgcagggaattgactgtttattagtaaattctctggtaattataactcaagaaataaatccttgaagattagttcctactttgtccaaggcactctggcagttactggattgtgacagcgttaacatagagttattccttgccataacagaaagtcacatttggaggtgaatattttgcatacttgttctggatttcactttttggaggcattcagagataagcttaaaggtaaacatactca

SEQ ID NO: 434162 - DNA, 414 bp, Homo sapiens
aaaattcacactgggtgctttggggctgttttccctcttgcgtggggattgactcaattgtgagactgtagccctcattgtgaagaagtagagaagcttctttatcctgctgttttgatacaagttgttactacagacttcttacattgtaacttaaaaaatgcaatcagtgtaaatttgtaacacatcagcattcttttaaatgttgatttcggtgaacttttgtttttttttttgtgatttgtagactcattctccaaggttaattcctccacagccccaggctccccctccaccgcctccgccgcctcagcagcagccgatcagaagcctgttccagccgcagccgctgcagccgctgcttccggtgcagcacccgcaccacccatccccgcctcagggaatgcacatgcc

SEQ ID NO: 434163 - DNA, 368 bp, Homo sapiens
tcaaataacctgcagctggtgataagtagaggggctatatgcattgccagtctgtggccggctccatatagcacagttagctctgctgtacgcattaagggtttagggcactggctctgtatagcattttgagtactgttggagttaatgtgcatttgtcagtaactggaataactttttatcagtcatggtttaaatctttgtaacagctatttatataatgatttagtttgagctcctctcttcattgggtgctttttttttttattttcgtcctctctagttctcagggtgttacaattagtctgaatgctacatctggcatggttacatcatttgaactctctgacaacactaacgaccaatct

SEQ ID NO: 434164 - DNA, 1404 bp, Homo sapiens
  misc_feature (1)..(1): n is a, c, g, or t
  misc_feature (7)..(7): n is a, c, g, or t
ngacgangcccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttccctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataatt

SEQ ID NO: 434165 - DNA, 4933 bp, Homo sapiens
  misc_feature (1)..(1): n is a, c, g, or t
  misc_feature (7)..(7): n is a, c, g, or t
ngacgangcccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttccctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgatacttccagaggaggaattaatgagcgacctgatgccctaagatgacataagctgttggaccttgctacctaaagcctctagagagccccaggctccccctccaccgcctccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggtaatgcatcctgagtgaacctccagggaaaaaatgtgtagcttcaaggctttgtgttccataaagtttcagatttttatttgagcctactaatttgtggttatttaaagaatagagtattagtctcaaatgtactgtttgttaaagacaacttttttcaacaatgttacttatctcaatacaagaaaaaaatgggaaaatgtcattttttgggaattgaaaaatgctacttattataattgtttaaagggtatactactaataaaattaggacatgttttgataatacatttgctcatctgtataaaatttcatgagaggtttaccagtggaaatactttgtcaaattatattcctgcagtagacagttttgaaaagagtctttgcatggagggaagaagatgttgctgttcactggttatttgaaggccttgagtgccctctgccgaccggcttctgcttcatgggttttcactggttatttgaaggccttgagtgccctctgcccatcggcttctgcttcatgggttgacatgcgtctgtaacatctttcttaccaagtgtatatttcttcttgtattgtagggttactattaaaatacatagcgatggtaaacttgaatcaactatttaaaaatacgtggaatacgtatctaagccaaaaacggaaaatgaatattatctagggtgttaaaggaagataaaatgtttttaagaatttttctttttattaaaaaaatgcaattaatacatccccattgcagaaattttcaagtatatataagaaaggaaattaaatactctcgttacctagaaacaattcaggagcttttttttttgtctttttttaaatgcacatcttctcgccacctgctttttccctccagtgtcacatatcatttgatcttttcatgtcagcgagttggttttgatgccatcgtttgagagtgctgtatgcggttccctttcatgctgtctgtgtggttgcatgtgtgtatactggtttcagtactttagtatcatagtgctacagggaacatgctttagagttatgagtttgtctgcatacctagttttccttaggacaattcaatcctagaattactggattaaatataaaatttaaggtaatagcttctggcttattactgcattttagatagtattaccttcatcagcaagtctaaaatgaagttttggtatcgctgaaagttcctttcttgtgttgaggttttttaggaaatgattgaagtgattatgcccggtgtaaccatttatgaactgttgtttctctttctttggaaatggaaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtggggtaagttgacaagttttatgagagcctctttgagtctgtgtatcacatagaatgtcctcatttgcagagaatgtttttgaagaaagaattaaaagttacctctgttatagtcttgtaaccaa

SEQ ID NO: 434166 - DNA, 3535 bp, Homo sapiens
  misc_feature (1)..(1): n is a, c, g, or t
  misc_feature (7)..(7): n is a, c, g, or t
ngacgangcccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttccctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgccccaggctccccctccaccgcctccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtggggtaagttgacaagttttatgagagcctctttgagtctgtgtatcacatagaatgtcctcatttgcagagaatgtttttgaagaaagaattaaaagttacctctgttatagtcttgtaaccaa

SEQ ID NO: 434167 - DNA, 948 bp, Homo sapiens
tttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccaaaattctaactgcaagctagcttcagaacctgtgagaaccccaccccacccaagcagctgcctagatttgtctactgctatcattttgtgtaaagcagttgttctaacttgaatgagtctagaattcatcattaagattgtgatatttatagagcatccaatgtggagatcatgatactttaaatataaaaaggaaaatatgatagaactgttattgacaaatgcttataatgattgaagggaaagtatctcaacattgtatcagtcacatatatttctgttgctttcaccattttctattcctgttgtaagtttggtggtagatttagttttgtttggtttatctgttttgtttgtgttttgtctcctggcaattgattagtgttaatcattaaatctattttgacacaaggttttatatataattagatcagttttccactttattacaattaagaaatgagtaaaatatggatataaaaggagaattggattgaaaagacaaatacacatttacaaggtcatacctttggtaggacagacaattctatatagaatattctcttttgataatgaaaaaaattaaagagagcacaaactttgactatgtcaaagtatttttatttttaattttttgagacaaggtcttgctctgc

SEQ ID NO: 434168 - DNA, 740 bp, Homo sapiens
tttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccaaaattctaactgcaagctagcttcagaacctgtgagaaccccaccccacccaagcagctgcctagatttgtctactgctatcattttgtgtaaagcagttgttctaacttgaatgagtctagaattcatcattaagattgtgatatttattagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagta

SEQ ID NO: 434169 - DNA, 2526 bp, Homo sapiens
gcagaagctggggcggctgagagcgcagcgcgggctcccgggagacgccggcccactgcccgcccgctcgccgcaggtaggcccggcccccgggaggtggggcgcggccaggtgtccccaggtagccgcctcctcccgtcctccgtcggccgcctccccggaccgaggcaggacctcaccccgcgcgtgttccccgggcgcccctctgcgaaccccaggcccttcccaggtttgcgcgcgggggccatccagaccctgcggagagcgaggcccggagcgtcgccgaggtttgagggcgccggagaccgagggcctggcggccgaaggaaccgccccaagaagagcctctggcccgggggctgctggaacatgtgcggggggacacagtttgtttgacagttgccagactatgtttacgcttctggttctactcagccaactgcccacagttaccctggggtttcctcattgcgcaagaggtccaaaggcttctaagcatgcgggagaagaagtgtttacatcaaaagaagaagcaaactttttcatacatagacgccttctgtataatagatttgatctggagctcttcactcccggcaacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttcttatgaacaggcagtggcgctgaccagaaaacacagtgtttcaccaccaccaccatatcctgggcacacaaaaggatttagggtatttaaaaaatctatgtctctcccatctcactgactaccttgtcattttggtataagaaatttgtgttatttgataggccgggcatggtggctcatgcctgtaatcccagcactttgggaggccaggagttcgagaccagcctggccaacatggtgaaacccggtctctactaaaaattcaaaaattacctaggcgtcatggggcatgcctgtagtcccacctacttgggaggctgaagcaggagaattgctcgaacctgggaggcagaggttgcagtaagctgagatcacgccactgcattccagcctgggcgacagagcaagactccatctcaaaaataaaataaaaaaagaaagaaagaaaagaagaagaaaagagaagaaggagaaggagatgaaggaggaggaggaggagaaggagaagaagaagaagaagaagaccacaaaagacatgactatccaactttttatgacaaactgcaaggaataaaggaagaataagtccatgtactgtaccacagaagttctgtctgcatcttggacctgaacttgatcattatcagcttgataagagactttttgactctatatccttgcagttaagaagaaagcacttttttgtaatgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcagtccactgtgcctggccccaagttttgcatcttttaatgccctctgaacaaatacatagagaaaactctcagaacaattaaaacctgcagagcaacagtgtcctccatgtcttaggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactattaggggaatctctagcatttctgtatttttaaagaatttgattcttttgtagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagta

SEQ ID NO: 434170 - DNA, 2363 bp, Homo sapiens
gcagaagctggggcggctgagagcgcagcgcgggctcccgggagacgccggcccactgcccgcccgctcgccgcaggtaggcccggcccccgggaggtggggcgcggccaggtgtccccaggtagccgcctcctcccgtcctccgtcggccgcctccccggaccgaggcaggacctcaccccgcgcgtgttccccgggcgcccctctgcgaaccccaggcccttcccaggtttgcgcgcgggggccatccagaccctgcggagagcgaggcccggagcgtcgccgaggtttgagggcgccggagaccgagggcctggcggccgaaggaaccgccccaagaagagcctctggcccgggggctgctggaacatgtgcggggggacacagtttgtttgacagttgccagactatgtttacgcttctggttctactcagccaactgcccacagttaccctggggtttcctcattgcgcaagaggtccaaaggcttctaagcatgcgggagaagaagtgtttacatcaaaagaagaagcaaactttttcatacatagacgccttctgtataatagatttgatctggagctcttcactcccggcaacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttcttatgaacaggcagtggcgctgaccagaaaacacagtgtttcaccaccaccaccatatcctgggcacacaaaaggatttagggtatttaaaaaatctatgtctctcccatctcactgactaccttgtcattttggtataagaaatttgtgttatttgataggccgggcatggtggctcatgcctgtaatcccagcactttgggaggccaggagttcgagaccagcctggccaacatggtgaaacccggtctctactaaaaattcaaaaattacctaggcgtcatggggcatgcctgtagtcccacctacttgggaggctgaagcaggagaattgctcgaacctgggaggcagaggttgcagtaagctgagatcacgccactgcattccagcctgggcgacagagcaagactccatctcaaaaataaaataaaaaaagaaagaaagaaaagaagaagaaaagagaagaaggagaaggagatgaaggaggaggaggaggagaaggagaagaagaagaagaagaagaccacaaaagacatgactatccaactttttatgacaaactgcaaggaataaaggaagaataagtccatgtactgtaccacagaagttctgtctgcatcttggacctgaacttgatcattatcagcttgataagagactttttgactctatatccttgcagttaagaagaaagcacttttttgtaatgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggctgggcgcagtggctcacgcctgtaatcccagcactttgggagggataggtgggcggatcacctgaggtcaggagtttgagaccagcctggccaacatggcaaaaccccgtctctacaaaaatacaaaagaaattagccagacatgatggcgggtgcctctaatcccagctactggggaggctgaggtgggagaatcgcttgaactcgggaggtggaggttgtagtgaggcgagattgtgccattgcactccaacctgggcgacagagtgagactccatctcaaaaaaaaaaaaaaaaaaaaagattatccaaaaagatattggacctactctttcttaggatttttttggcggggggttagaaatacttcacagaatttgacatttcagtataaatctgtgaccttaatataatcacttggttttatatgttaaattattgcacagcagtcatcatattttgcagagtttagttcttaactcttgctgtcagtcatgttttattataggtagtggggtcagtag

SEQ ID NO: 434171 - DNA, 894 bp, Homo sapiens
tttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccacagctgcctagatttgtctactgctatcattttgtgtaaagcagttgttctaacttgaatgagtctagaattcatcattaagattgtgatatttatagagcatccaatgtggagatcatgatactttaaatataaaaaggaaaatatgatagaactgttattgacaaatgcttataatgattgaagggaaagtatctcaacattgtatcagtcacatatatttctgttgctttcaccattttctattcctgttgtaagtttggtggtagatttagttttgtttggtttatctgttttgtttgtgttttgtctcctggcaattgattagtgttaatcattaaatctattttgacacaaggttttatatataattagatcagttttccactttattacaattaagaaatgagtaaaatatggatataaaaggagaattggattgaaaagacaaatacacatttacaaggtcatacctttggtaggacagacaattctatatagaatattctcttttgataatgaaaaaaattaaagagagcacaaactttgactatgtcaaagtatttttatttttaattttttgagacaaggtcttgctctgc

SEQ ID NO: 434172 - DNA, 2479 bp, Homo sapiens
cagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacaaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaa

SEQ ID NO: 434173 - DNA, 2382 bp, Homo sapiens
cagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacaaaggagagatccagattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaa

SEQ ID NO: 434174 - DNA, 2356 bp, Homo sapiens
aagttattaccagtagttgagtcctgaactcacctatgaatattcagattttttttttcctggtctagcaatgctgtcataaacttctctagacatggtttttttgtgtgtgtgtgtctttttacattcttttggattattaacatagcaggaagtgaaaaagtgactttgaataacatcatggaggtgaaagtgactttgagtaggatcatgtaaagatttgtacattaatgagcttgccagtttgttccagaagccaaaaggtcagctatactcagaagctcttaaaaattctgacttctcttttttgatcagcctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaa

SEQ ID NO: 434175 - DNA, 3091 bp, Homo sapiens
cagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacaaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatatgtgtgttttatggggggggggttatttgtttgtttgttagttggtttgtttttcagacagtctctctctatcgcccaggctggagtgcggtggcacaatcttggctcactgcaacttccgcctcccgggttcaagcgattcttctgcctcagcctcccgagtagctgggattacaggcgcgcgccaccacgcccggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacagcgcctgtgactcctcatgattcttactgaagctgttgatgacaggatatcatggtgacgtttttgtaatgaaata

SEQ ID NO: 434176 - DNA, 3227 bp, Homo sapiens
cagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacaaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaaacaaaaaaaaaaaaaaaaaaaaaaaaaaaaaccccggggcgctcttctttgtgtgcgggtgtgcgcgggaaaaggagggttatggaaaggggccccgtgtgggccctagcggtgttttcccgtgaaccccagtctttctctgtgttcacacaggggggctaaatatctctgccgcggttcccctcttagagggggagtcgcgttataatattggcgatataaagcccggggtttaacccctggtctttaattggaattcgcgggaagaaagcgcacacagaacagcgcaacacaagacacaacgggcggagcacccgcccccagcaaaacaagcaagccgacagcggggggctccaaccacaacagtgtcgggcccaccaacacagacgccggagagcaacaggcgaaaaagagacaaaaacacaaaccgtcgccccaacaacataaacaaacgcagaaaaaatgggagggagggaggcaacgaaggggcagggggggggaagaggggaaggacaagagctatagaaaaagagattgatggagagaggtaggggcagtagacgggagccgactgacgatagaccgaaggatggagcgaggcgaagaactaaatgcaagtgaagagaaaaagagagaaggagcgggagaggaggcgggtggtaggacggcaccgaataggcgaagcgaggggacggaagaggatgagagagagtggggacactagaaggaagcagtgaggcgagagaga

SEQ ID NO: 434177 - DNA, 1531 bp, Homo sapiens
cagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacaaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaa

SEQ ID NO: 434178 - DNA, 1989 bp, Homo sapiens
caggcaacagctggaatgggctttcctccactaggaaccctgaaattgagtaatctagggtgaattaatactgctgtcttcccttcctccctttggatctaatatcataaacgtttttaaagaactggaagagggtgagtgtgtagagaaaaggccaagtaggaaagttacaggtgagattaatgaattcatactgttactgtataaatacacaatttttttaaacagcaccatttccaagttatacacaatatgattatgacttggcacaacttttaaaggtggaaaaggctagttgctagttcagtaataaaatacctggtacatagaacgataaggagctgtattctacctgctacacattgtgcattttacacctccagctaggacagaaacaagccacaagcggggaatacccgcccaaattaatactggaaagtttacaaaaccttcacttctcataagggtgatgctaccagcggcttgcttcacctggaattagagtaactgatttttaaagacaactgagaatattaactcgcttcaaacaataaaatagtcattttgccgacatttcataaaatcgccagttttaagctcagttcagaggcttttaaaaaaatattctagacctagtaaagtgcctccattcataaaatgaaacatccaagattgagacaatttcatactgatgcgcatctaaaataggtcgacgtatacagtaaataaacagcgcctctaagttgccatatttcagttagtggaatacacacccagccttcgccgttctggatgtgcaaactagaaactgaagacaaatggggatttcagcgtctagtcccaatcgttcagcacggaagtactccacacggtcggctgcttttcaaaaaccaccaggacgacgtcccatgtcgagccgaccgctgagccgcacgcctccccacggcgggggcgagatggtgcgcagacctagcggtgcgaggggcggcggcgaccctgggcggccgggagcccgggccttcagcgcagcttcttgccaggcgggccgtccctggcgctgcggggcggcgggcgggcgggcggcggcggcactttggagagcgggcagtacttgatggtgtgcgcgttgtcgccgctggcgccgcacaggggacacgtgtagcggcgcagcacgggacacagcactcgcccgtcggggcccttgaggatatgggtggtgtagagcgccatcgcctccttgttgttccggcagaacacgcacacctgcagctcgggcttcagcagccgggcggccgccgccccggaggccgcgtgcagccggggctcggccgcccacgccggggcccgctcctcgcgcggcgtcgcctcgctggtggtggtggcggcggcggcggcggcgggcgcgcagcccagcagcacggcggcggcacgacccgcgaacgggctcagctcggcgaagcgctcctccagcagcccggcctcggcggggcccgcgcacagctccagcgcgcgcaattccagcgcgctccccaggtagcggccccgggaccccggctcgtcgctgtcgtcgtcgtcgtcctcgtcgtagtcgggcggccccagcgccggccccagcgccccaggcccggcccccgtgtggggggagcagcaggacgacgaggaggaggagggcggggagccgccgccgccgttcccaccgcgggcgcagccgaagcgcggctcgccgtccaccgctttggtgatgagcgtggcgagccccaggtagtcgttccaggagctgaagggctgcgggtgcgccgggcccggggcgctcacgtagcgggcgctgggcacgagcgccatgggcgggggggcgcggccgcggcggggcgagcggggcgcccaggggaaagcctccatgggcgggctgcgggccgcgcgccgcctccccgccgccggcgcgggccggacggaagggacacgccgagcctgcccgccggcctgccgcgg

SEQ ID NO: 434179 - DNA, 2244 bp, Homo sapiens
  misc_feature (307)..(307): n is a, c, g, or t
tttacaaaaattattaacgccggccatttttcccattggccccccaaggggggggcacctgtttttggaaaggggacacctgggggggcgcctcttttgcattattaccccacgcgggataaaggggaattttttccaaaagcgcttttaattgggggaaccccgaggtttttccgagtccgcgttttttaaaaccggccccctttttgttaaaacccccccttaaagggggatttgcccaaaagacgttaaatatgggccccagagaaaaaagtttaagggtataaaaaatttggggaaaaagggnaaaaaaatattttttttttttttttttttttttttttttttttttttttttttttttttttttttttttttttttttttttttttttttttttttttttttttttttttttttttttttttttttttttttttttttttttttgttactgtataaatacacaatttttttaaacagcaccatttccaagttatacacaatatgattatgacttggcacaacttttaaaggtggaaaaggctagttgctagttcagtaataaaatacctggtacatagaacgataaggagctgtattctacctgctacacattgtgcattttacacctccagctaggacagaaacaagccacaagcggggaatacccgcccaaattaatactggaaagtttacaaaaccttcacttctcataagggtgatgctaccagcggcttgcttcacctggaattagagtaactgatttttaaagacaactgagaatattaactcgcttcaaacaataaaatagtcattttgccgacatttcataaaatcgccagttttaagctcagttcagaggcttttaaaaaaatattctagacctagtaaagtgcctccattcataaaatgaaacatccaagattgagacaatttcatactgatgcgcatctaaaataggtcgacgtatacagtaaataaacagcgcctctaagttgccatatttcagttagtggaatacacacccagccttcgccgttctggatgtgcaaactagaaactgaagacaaatggggatttcagcgtctagtcccaatcgttcagcacggaagtactccacacggtcggctgcttttcaaaaaccaccaggacgacgtcccatgtcgagccgaccgctgagccgcacgcctccccacggcgggggcgagatggtgcgcagacctagcggtgcgaggggcggcggcgaccctgggcggccgggagcccgggccttcagcgcagcttcttgccaggcgggccgtccctggcgctgcggggcggcgggcgggcgggcggcggcggcactttggagagcgggcagtacttgatggtgtgcgcgttgtcgccgctggcgccgcacaggggacacgtgtagcggcgcagcacgggacacagcactcgcccgtcggggcccttgaggatatgggtggtgtagagcgccatcgcctccttgttgttccggcagaacacgcacacctgcagctcgggcttcagcagccgggcggccgccgccccggaggccgcgtgcagccggggctcggccgcccacgccggggcccgctcctcgcgcggcgtcgcctcgctggtggtggtggcggcggcggcggcggcgggcgcgcagcccagcagcacggcggcggcacgacccgcgaacgggctcagctcggcgaagcgctcctccagcagcccggcctcggcggggcccgcgcacagctccagcgcgcgcaattccagcgcgctccccaggtagcggccccgggaccccggctcgtcgctgtcgtcgtcgtcgtcctcgtcgtagtcgggcggccccagcgccggccccagcgccccaggcccggcccccgtgtggggggagcagcaggacgacgaggaggaggagggcggggagccgccgccgccgttcccaccgcgggcgcagccgaagcgcggctcgccgtccaccgctttggtgatgagcgtggcgagccccaggtagtcgttccaggagctgaagggctgcgggtgcgccgggcccggggcgctcacgtagcgggcgctgggcacgagcgccatgggcgggggggcgcggccgcggcggggcgagcggggcgcccaggggaaagcctccatgggcgggctgcgggccgcgcgccgcctccccgccgccggcgcgggccggacggaagggacacgccgagcctgcccgccggcctgccgcgg

SEQ ID NO: 434180 - DNA, 1297 bp, Homo sapiens
caggcaacagctggaatgggctttcctccactaggaaccctgaaattgagtaatctagggtgaattaatactgctgtcttcccttcctccctttggatctaatatcataaacgtttttaaagaactggaagagggtgagtgtgtagagaaaaggccaagtaggaaagttacaggtgagattaatgaattcatactgttactgtataaatacacaatttttttaaacagcaccatttccaagttatacacaatatgattatgacttggcacaacttttaaaggtggaaaaggctagttgctagttcagtaataaaatacctggtacatagaacgataaggagctgtattctacctgctacacattgtgcattttacacctccagctaggacagaaacaagccacaagcggggaatacccgcccaaattaatactggaaagtttacaaaaccttcacttctcataagggtgatgctaccagcggcttgcttcacctggaattagagtaactgatttttaaagacaactgagaatattaactcgcttcaaacaataaaatagtcattttgccgacatttcataaaatcgccagttttaagctcagttcagaggcttttaaaaaaatattctagacctagtaaagtgcctccattcataaaatgaaacatccaagattgagacaatttcatactgatgcgcatctaaaataggtcgacgtatacagtaaataaacagcgcctctaagttgccatatttcagttagtggaatacacacccagccttcgccgttctggatgtgcaaactagaaactgaagacaaatggggatttcagcgtctagtcccaatcgttcagcacggaagtactccacacggtcggctgcttttcaaaaaccaccaggacgacgtcccatgtcgagccgaccgctgagccgcacgcctccccacggcggggagcagcaggacgacgaggaggaggagggcggggagccgccgccgccgttcccaccgcgggcgcagccgaagcgcggctcgccgtccaccgctttggtgatgagcgtggcgagccccaggtagtcgttccaggagctgaagggctgcgggtgcgccgggcccggggcgctcacgtagcgggcgctgggcacgagcgccatgggcgggggggcgcggccgcggcggggcgagcggggcgcccaggggaaagcctccatgggcgggctgcgggccgcgcgccgcctccccgccgccggcgcgggccggacggaagggacacgccgagcctgcccgccggcctgccgcgg

SEQ ID NO: 434181 - DNA, 1893 bp, Homo sapiens
caggcaacagctggaatgggctttcctccactaggaaccctgaaattgagtaatctagggtgaattaatactgctgtcttcccttcctccctttggatctaatatcataaacgtttttaaagaactggaagagggtgagtgtgtagagaaaaggccaagtaggaaagttacaggtgagattaatgaattcatactgttactgtataaatacacaatttttttaaacagcaccatttccaagttatacacaatatgattatgacttggcacaacttttaaaggtggaaaaggctagttgctagttcagtaataaaatacctggtacatagaacgataaggagctgtattctacctgctacacattgtgcattttacacctccagctaggacagaaacaagccacaagcggggaatacccgcccaaattaatactggaaagtttacaaaaccttcacttctcataagggtgatgctaccagcggcttgcttcacctggaattagagtaactgatttttaaagacaactgagaatattaactcgcttcaaacaataaaatagtcattttgccgacatttcataaaatcgccagttttaagctcagttcagaggcttttaaaaaaatattctagacctagtaaagtgcctccattcataaaatgaaacatccaagattgagacaatttcatactgatgcgcatctaaaataggtcgacgtatacagtaaataaacagcgcctctaagttgccatatttcagttagtggaatacacacccagccttcgccgttctggatgtgcaaactagaaactgaagacaaatggggatttcagcgtctagtcccaatcgttcagcacggaagtactccacacggtcggctgcttttcaaaaaccaccaggacgacgtcccatgtcgagccgaccgctgagccgcacgcctccccacggcgggggcgagatggtgcgcagacctagcggtgcgaggggcggcggcgacctttggagagcgggcagtacttgatggtgtgcgcgttgtcgccgctggcgccgcacaggggacacgtgtagcggcgcagcacgggacacagcactcgcccgtcggggcccttgaggatatgggtggtgtagagcgccatcgcctccttgttgttccggcagaacacgcacacctgcagctcgggcttcagcagccgggcggccgccgccccggaggccgcgtgcagccggggctcggccgcccacgccggggcccgctcctcgcgcggcgtcgcctcgctggtggtggtggcggcggcggcggcggcgggcgcgcagcccagcagcacggcggcggcacgacccgcgaacgggctcagctcggcgaagcgctcctccagcagcccggcctcggcggggcccgcgcacagctccagcgcgcgcaattccagcgcgctccccaggtagcggccccgggaccccggctcgtcgctgtcgtcgtcgtcgtcctcgtcgtagtcgggcggccccagcgccggccccagcgccccaggcccggcccccgtgtggggggagcagcaggacgacgaggaggaggagggcggggagccgccgccgccgttcccaccgcgggcgcagccgaagcgcggctcgccgtccaccgctttggtgatgagcgtggcgagccccaggtagtcgttccaggagctgaagggctgcgggtgcgccgggcccggggcgctcacgtagcgggcgctgggcacgagcgccatgggcgggggggcgcggccgcggcggggcgagcggggcgcccaggggaaagcctccatgggcgggctgcgggccgcgcgccgcctccccgccgccggcgcgggccggacggaagggacacgccgagcctgcccgccggcctgccgcgg

SEQ ID NO: 434182 - DNA, 4071 bp, Homo sapiens
  misc_feature (222)..(222): n is a, c, g, or t
  misc_feature (296)..(296): n is a, c, g, or t
  misc_feature (434)..(434): n is a, c, g, or t
  misc_feature (532)..(532): n is a, c, g, or t
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcntggccgcgccgggctgtgggcactgcaggaggcccctgtgcaggtggagatcgccgcggccctggcgggactcnttgctggctcttgggcgcgctgatgcccatcatctccctgagtttctgagccctatctctcatgtgtcagtggtcaccgccgaatccagacactccggccctgttccggaagagccctgatatccgtggctccatggngctgtctgtcgataccatgcactctagctctcaaggaggaaaggttttgtggaagggaatagagacttggaataacagacctgtgctaattagagacnggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccca

SEQ ID NO: 434183 - DNA, 3400 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacacctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccca

SEQ ID NO: 434184 - DNA, 3611 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccca

SEQ ID NO: 434185 - DNA, 3540 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccca

SEQ ID NO: 434186 - DNA, 3867 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaacatgtctgtttatggctctttggtcccctttgctcccagtggtgacttttgtgcttctgagttgtcccctgagagcttggtctgggaaaagaggaggaggggtcctcgctggaggaagaggaactttctagtcatgggtagggtatgggcacagtggttccggttctacctactttctggactaactgacagtgccctggcttttgcaggctctttctcctccacttctcactaaatggaagcttccccgctcc

SEQ ID NO: 434187 - DNA, 3272 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggacccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccca

SEQ ID NO: 434188 - DNA, 2693 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaacatgtctgtttatggctctttggtcccctttgctcccagtggtgacttttgtgcttctgagttgtcccctgagagcttggtctgggaaaagaggaggaggggtcctcgctggaggaagaggaactttctagtcatgggtagggtatgggcacagtggttccggttctacctactttctggactaactgacagtgccctggcttttgcaggctctttctcctccacttctcactaaatggaagcttccccgctcc

SEQ ID NO: 434189 - DNA, 1121 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434190 - DNA, 1033 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434191 - DNA, 1137 bp, Homo sapiens
gacactgagtcaggaaaatctcttgaacctgggagacggaggttgcagtgagccgaaattgtgctgctgaactccagcctgggcaacagaggtgagtgagactccatctgaaaaaataaaaataaaaaaccttctcaaaaacaaaaaatttagttaagtatcataaagacatcctgaaggtaggggaatttttaaaaatctgttttggagaaagattacatactctgatcatagttgtgatgctaccagtataatgttttatacctgaagcaaggaagtcagtgtggagcaaggtctagagcagtaaactgagacgctggagagtctaccattaatcagatctgtgatggtggggaggccttgctctctcttgcctccatttcttcatctcttcaaattattggcagttgggttaggatccagctcatgtgtgctattttaagactcccttggcttgctttttctctggttcctccagggatggaaatttacccctgaccactcttgccttagtacctcctcccccacgcagttgtgaggaaccagcagtttagttccttaaaaacatagttgcctgttctgtcctttacctgacattttctatcttgtttcttttaaacagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434192 - DNA, 870 bp, Homo sapiens
acctccgatataacggagctggaagtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434193 - DNA, 1269 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccgccccaggaaatcggtaccagtgttatcctcatggtacagtgaagaatactgagacttaggttgcgtagcttgcaggttggacacacttctttctgactgctggagagctgtgcttttaactacctctgatccagcttgttttctgcaggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434194 - DNA, 1018 bp, Homo sapiens
acatccattgaatgctcactacagccccaggaaatcggtaccagtgttatcctcatggtacagtgaagaatactgagacttaggttgcgtagcttgcaggttggacacacttctttctgactgctggagagctgtgcttttaactacctctgatccagcttgttttctgcaggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434195 - DNA, 1057 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccgagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434196 - DNA, 980 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434197 - DNA, 1854 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataataaaaaaaaaaaaaaaaaaaaaaaaaaaaaaaaaaaaaaaaaaaaaaaaaaaaaaaaaaaaaaaaaaaaaaaaaaaaaaggggggcccgcccgcagcaaaataaaaacgcgggcttcttcacccccagccacgcggtgggagtagaaaagaccgcgcgccccctttaggaaagagcagcttcttccaccacaaagaataatactgggcgccctcagaatgataaaaagcatttctcttacaggaggggcaccaacaaacactgctccctgagtgaaagaacacttaaacaaaacgacccccggcgtgagtaagagcaaaaagggggcgccatataaaatgtaacaccaccgcggtggttaatgagcaacaacagaaaatgaccacaaagataaaatcggtgtgagcgagaaaagagtgtacgccgcgcagccgtgtgggagaacaacaaaaggagaacgacacaccccaaacacagaccggggtgaattaataggtgcgacccccccacatgggagggaaagtgtaggtcaaccgaaggaggggaagaacaaagccccccgcctatcacccaaattatgcgccgaacggggagaggtgaacataaacccccacgagggctgaacaattaagggcggaccgccgcaagaacattatctggaaagatcatcagaaaacaacaacattaaagcggggaagattgttgcgagaaaaaactgacaacgaaagatgacagg

SEQ ID NO: 434198 - DNA, 1300 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataatataaaaaaaacagggggcggttcaagttcctaggggccagtaggtaccagtttggtcaagggccataggatagataaatagaggcggttaagttgaggggaacgatgggttgaagactttgggggaaaggacaggatagaggtaatggtagtgacggtgtgggagaggaaataagagaaa

SEQ ID NO: 434199 - DNA, 1076 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434200 - DNA, 1181 bp, Homo sapiens
  misc_feature (1127)..(1127): n is a, c, g, or t
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataataaaactngtgccgaattcggcagagcttcaatcagaggtaattattaagccagcttgccct

SEQ ID NO: 434201 - DNA, 1123 bp, Homo sapiens
  misc_feature (532)..(532): n is a, c, g, or t
  misc_feature (535)..(535): n is a, c, g, or t
  misc_feature (537)..(537): n is a, c, g, or t
  misc_feature (588)..(588): n is a, c, g, or t
  misc_feature (600)..(600): n is a, c, g, or t
  misc_feature (604)..(604): n is a, c, g, or t
  misc_feature (607)..(607): n is a, c, g, or t
  misc_feature (622)..(622): n is a, c, g, or t
  misc_feature (633)..(633): n is a, c, g, or t
  misc_feature (647)..(647): n is a, c, g, or t
  misc_feature (656)..(656): n is a, c, g, or t
  misc_feature (664)..(664): n is a, c, g, or t
  misc_feature (681)..(681): n is a, c, g, or t
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagcgctccatccggtnccncngctggcattaggggaaggcggccccaccaccccggaaaacccacgcccgcnggctcaatcgcnggcnccngttcgccgacggccnccaaagtgggngtccgcacgccccnccgcccccncccgccgnagccacgcccccgcccngactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434202 - DNA, 1459 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtctttacatttttaagaataaatttgaaatagagtaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaagaaaaacataacaaaaagaaacgaaaaaacagagacgaacacaaaaagcaacagataagacaactcaaaacaccagcaaacaccgagaggacacgacaacaaagccggaggcaggcgacgaagaacagccacccacgccgcacaacacgacaaaagagaaccgcagcccagcgctcgggagacccagacaacgcagatacgacgagacgcagcgcagacgaggacagagcatcccccacgaccaccctcggagagacgaggcacggggcacacagccgcacaccgcccactagagcacgccggagagcacgcaactagagactcggacgaaacacagccacacgaagcagcacaacagtgcacgcaaacaacccagcagaccagctgcaaagacaggacagagggagcgaggagacacgaggccaaaag

SEQ ID NO: 434203 - DNA, 1063 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 434204 - DNA, 1237 bp, Homo sapiens
ctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccgccccaggaaatcggtaccagtgttatcctcatggtacagtgaagaatactgagacttaggttgcgtagcttgcaggttggacacacttctttctgactgctggagagctgtgcttttaactacctctgatccagcttgttttctgcaggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtctttggcttcttcggatctgtggtaacttcaggtaaatgtaggggtagttaggttgaaactattctgtttggaacggggacaagttttgggatacaaatcgttggctttagacgaggttgatggtacggattcagaaagtcttttcaaaaaaaaaaattggcggcgaattaattgggggcatagtg

SEQ ID NO: 434205 - DNA, 3729 bp, Homo sapiens
ccacgcgtccgccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagttagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaactt

SEQ ID NO: 434206 - DNA, 3028 bp, Homo sapiens
ccacgcgtccgccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagttagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacataatgccatcaagtttgactgcttcaagcagattagattccagctgtcttccaaccctctagtgaataccagaattattgttttttctgtctttcgagaccagggtctcact

SEQ ID NO: 434207 - DNA, 4224 bp, Homo sapiens
ccacgcgtccgccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagttagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtctaagccttctcagcccagaccccctcaacctaagtcatcctcaaccaatccttcacaagctaaggcacaccactcaaaagcagggcagaagaggggagggaagcattaaagagctaactccagagatctataaagcatatcctttacccaggccattcctatcatatagtaagcagaagagttgccatgaaagtaaaagactactgtcattagcatgtaaaacaaagaaagatatacatgaccgaattggatatctttgtttgtttgtttgagacagagtttcactcttgttgcccaggctggagtgcaatggcacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaactt

SEQ ID NO: 434208 - DNA, 3384 bp, Homo sapiens
ccacgcgtccgccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagttagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaactt

SEQ ID NO: 434209 - DNA, 3023 bp, Homo sapiens
ccacgcgtccgccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagttagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacacacatacacacacacacatgcagaggaaacagacttactgggattcaaaactctacaatatctgagacacacagatgacccacagagtacggggccaggcctcctcc

SEQ ID NO: 434210 - DNA, 2108 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434211 - DNA, 1441 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttcta

SEQ ID NO: 434212 - DNA, 901 bp, Homo sapiens
catgctggagtgcagtggcacaatctcggctcactgcaacctccacctcccatgttcaagtgattcttctgcctcagcctcctgagtagctgggattgcaggtgtgtgccaccacacctggctaatttttctatattttatagagacgggggagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggagtgcgtcaccatttatgggtgtgttagcgaattagtctgtgtagaaaagactgaac

SEQ ID NO: 434213 - DNA, 536 bp, Homo sapiens
tcatcgagctcggtccggtgttatcgatgctcctctttctccttttgctacttctattgctgaactagtcacccctcattttttcttcctcatatttcaggtgtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgtgtaagtgaacttgagttttttcttccatcatcaaaaaaatgtagaagcaattatccaacgggaattccataacccatttcttatatgtgttggcatgtcagcaaaagtgtcagaattttctaaaacagctttctacttgttatccaactagacccagataacacagaactgaggtcaagaactatgaggtcaaggccttatagttcattaattcca

SEQ ID NO: 434214 - DNA, 2329 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtttattggtgagactttatttaatgcacatctgtcttaaatacctgagaaacttggcgacgaccctataaacagtgaagcaaacacttcagctgtttcaaatactgtttagtaaagcttgaatactttattaacttgcagccagaataaaacaattccagtgggatcctatttttaaacctggcacgagttttatatacatgttagcccagttttatatacat

SEQ ID NO: 434215 - DNA, 2207 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggttaaaaaaaaaacccaaacaacaaaaaaaactctcataatacaacaggggatacagtcatatgcctctaaaagggtcatctccattggatgattcttaaaa

SEQ ID NO: 434216 - DNA, 2174 bp, Homo sapiens
  misc_feature (2147)..(2147): n is a, c, g, or t
  misc_feature (2171)..(2171): n is a, c, g, or t
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatcttccctacacccttctctgcctttattttttgatttgtggcaacttgtaactaggggtgtttatggggaataaagggaggantgggaaaaaaggataaaaaaaaanaaa

SEQ ID NO: 434217 - DNA, 2054 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataagtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434218 - DNA, 2183 bp, Homo sapiens
catgctggagtgcagtggcacaatctcggctcactgcaacctccacctcccatgttcaagtgattcttctgcctcagcctcctgagtagctgggattgcaggtgtgtgccaccacacctggctaatttttctatattttatagagacgggggagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434219 - DNA, 2048 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattatttggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434220 - DNA, 1433 bp, Homo sapiens
  misc_feature (1415)..(1415): n is a, c, g, or t
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaataccatttcaanctcggggatcctctgaat

SEQ ID NO: 434221 - DNA, 1547 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatactaaacgacaaaataaacaaatggtctattacctgcatttgtgtccgggaacaatgtcagaaagttgcatttgctggtcgttcagaattaaaggaggaggtataactcgggcagggaaaacgttgatgagtttgcggaaaaa

SEQ ID NO: 434222 - DNA, 1387 bp, Homo sapiens
  misc_feature (1299)..(1299): n is a, c, g, or t
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatagagtcatggtacgaaatattaaagatagaatcgatcttatgcgatagttgtgtaacagattagcgtatanatatctgaaagtggtagtatatgagctttgtcagccagcaagtatattgtccagacgcaatgaatacctcctggagatgttacaggca

SEQ ID NO: 434223 - DNA, 2040 bp, Homo sapiens
aattcgcggccgcgtcgacgcgagaagacgacagaaggggaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434224 - DNA, 1061 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaatgggcccgaattttagcggtcacaaaccaaaggggggctaaattaccgaggcacgtacgccacctttggaagggcccaagggggttaaaagacgggggaacacaggaaagtggtgggaaccctcggtggaac

SEQ ID NO: 434225 - DNA, 2166 bp, Homo sapiens
  misc_feature (1)..(1): n is a, c, g, or t
  misc_feature (274)..(274): n is a, c, g, or t
nacgggtgtgcgtacgcacggcatgtcgcattaggtgctggcgacgggcgaccagaatcagcgataacgttggaagcaatgagtgcgaatagtctagattattcgtaccgcagcattcccgtgtgctctagtggaactgagttgtcttgcgcctgcttctacccgaattgacatataagcgccgcggcgggacatatccagaggcgcttctgcacacaatgtccacggatgcgacgtactggaaggctacattagttgcgtaatctactcaagnacacgagaagttacccataggctgagtcgtgcgtagtcactactagaatgtattgtcccactgttgtcggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434226 - DNA, 2087 bp, Homo sapiens
aaggcgataaacgatacgttgggaacagtggacgtaaatatctgccctcactccttgcgtccatgggcatggatctctatcgcacgagtgcttcggcggatctgcaattagccgcgggcgatactccagcggatattatccaggacatggaagcaacacgcggataggttgagcgaaacatgattcctatataacgccagtacctagacgtgaccatggatggtggtctgatcatgcatggattcccatgtagggctatcatgagagtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434227 - DNA, 2281 bp, Homo sapiens
catgctggagtgcagtggcacaatctcggctcactgcaacctccacctcccatgttcaagtgattcttctgcctcagcctcctgagtagctgggattgcaggtgtgtgccaccacacctggctaatttttctatattttatagagacgggggagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggctggagtgcaatggcgtgatctcagctcactgcaacctccaccttctgagttcaagtgattctcctgcctcagcctcccaagtagctgggattacaggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434228 - DNA, 1856 bp, Homo sapiens
tttccttaaaagccattaacggtcatctactgtccgtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434229 - DNA, 2079 bp, Homo sapiens
catgctggagtgcagtggcacaatctcggctcactgcaacctccacctcccatgttcaagtgattcttctgcctcagcctcctgagtagctgggattgcaggtgtgtgccaccacacctggctaatttttctatattttatagagacgggggagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434230 - DNA, 1794 bp, Homo sapiens
actttttcctttttttttttggttgagcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434231 - DNA, 2054 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaatctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434232 - DNA, 1965 bp, Homo sapiens
catgctggagtgcagtggcacaatctcggctcactgcaacctccacctcccatgttcaagtgattcttctgcctcagcctcctgagtagctgggattgcaggtgtgtgccaccacacctggctaatttttctatattttatagagacgggggagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtgggtgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434233 - DNA, 1674 bp, Homo sapiens
gagatggtatcaacccagagtgcccttacggccgggggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434234 - DNA, 1986 bp, Homo sapiens
aattcgcggccgcgtcgacgcgagaagacgacagaaggggaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaatctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434235 - DNA, 1547 bp, Homo sapiens
agaggatccccctcggctctacctagtctgccacgatgaagagacatcagaagtctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434236 - DNA, 1649 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 434237 - DNA, 826 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggagtgcgtcaccatttatgggtgtgttagcgaattagtctgtgtagaaaagactgaac

SEQ ID NO: 434238 - DNA, 474 bp, Homo sapiens
gaaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagagctggtgggcatgtggtgcacctgggcctggtggtctcagccctgccagggaggctttgagtgcacccgcccgtctctcccccaggctctcacatgcctgtgttttccaaagtagagatgtggcttt

SEQ ID NO: 434239 - DNA, 3906 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434240 - DNA, 3713 bp, Homo sapiens
cggaaatcatcctagtaataaagtgaaatcagacccacaacgaatgaatgaacagccacgtattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434241 - DNA, 3993 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaagcaaggccaaatggaactttctttccctggtttcaaaggtttcccttttggttcttcctcaaggaaaaaaattaccgtggttaaaccaattaacagggtttcccaacaaggtggaacccaagggttaaggaattgggaaccaaggccccggttcagggtttttcccaaccaaagaaagaaccaactttcccttaagtggaattaagggtattgaaaaattctggtttaattaaccaaaggaaagaagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434242 - DNA, 2534 bp, Homo sapiens
accttgaccagaatgtttctcacaacaggtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434243 - DNA, 1673 bp, Homo sapiens
cccaattcttctccacgacaacacctgactgcgtgtcgcacaaccagtgcttcaaaagttgaaggaattgggctacaaagttttgcctcatccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434244 - DNA, 4017 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatgagatgtttattggattattgactcactttggtgtctgcttgttgattcaggatgctgtaatgggacctaacattaaaaattaatgacatgttttttttaagagaaaaaaaac

SEQ ID NO: 434245 - DNA, 1886 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaactttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434246 - DNA, 1657 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatttaaaatgagagacattttgtaaccctgtaaaatacatagggaatataacattccagtgtatacaaagaaggcaaattctttaatcaaataaagcgcattataaaatga

SEQ ID NO: 434247 - DNA, 688 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434248 - DNA, 3852 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagatcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434249 - DNA, 3807 bp, Homo sapiens
gacattgcagcttgcgaacggggtgtccgactcagacgtgttggagctgccgttcagcagaccgtactcgtagtcggaccggaaccggtacgtaagcgcgtccctgagctgcggtaaccatggcgctgctgacagtaccagtctggaccctggccggagacggtctagcttcaggacggtctgcgtatacgaccactgctgcgatagggattagcagcttttccaaagctcatgaacactggaaaacaacatacgtttgttgaaacagagagtgtaagatatgtctaccagcctatggagaaactgtatatggtactgatcactaccatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 434250 - DNA, 4453 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatgaaaaaaaaaaaaaaaaaaaaaaaaaaaagggggggggggaaaaaatagtcctccccaagagagggcgccaaagaaagtcacaggcgatccccaggatctctggtgcaaccacaggggcgcccccaaaatagagagacgcgcgcggattatatatagcgcagagggcaacgtagtgcgacagcgacggttaacaaacacggcgtcagcagacgtggaacaacaccgcggcaccaagccgtggggcacaaccgtggggcgcaaaacggggaacaccaataaacccccggggcgcggatgcggcccgactacagggggggacgccaaagaactaaaccaacaaaacaagcaacgaattctagaaaaagcgccccaaacggagacgggagatacacaaccatccgagcaatgttgtagcacagagagcaggctaaacgacagaggggcggcgagcacacgccacaaagagagcaagcacaatcagatgcccgggcgaagggggcacggacaacaagagatctgagagcgcagcgaagccagggagcaacaag

SEQ ID NO: 434251 - DNA, 2204 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggtactccattttagttgagaacatatatagggaaagtggtaggacagtaggaacacgtataggatgccagacaggtagcatggctttttgtggtcagataaagctcagaaaaaaactgatgtctcctacaggaattccctttctaattcattgtatgatcgtggtcaaattcttttattgctttacctcagttttcctctctagatcagacaaagtaaagaaatggaatgttaatacagataaaagtacttgtggattatgcaagattcataaacacttagttgcctgtttttttttaaccttatatattttaaagtcgatttgccaaaacaccccaacacatggtttttttaaggccttgctgtcacttgatttatacccaaagaatgaaattgttttatttagaagacaaaattactacaaaaaaaaaatccattctattacaaatggaaattatttgagggttatttatgtcacagctccctttattagtacaaataatcatgagccaattctgttgcaaactctgtcctttaggtaggcaaagcaatggagatgtgtgagctgttccttcggatttttttttttttttttttttt

SEQ ID NO: 434252 - DNA, 1000 bp, Homo sapiens
agacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggaaggcgcaggaattcagaaaactctaaagcttggaaatgctatcgtttgtgccacaaagattaccctgaaaaggtagagagaggtcaaaaagcagaaccaaattggggattttcaaaggctgctctctaacagagtttaaaatatccgtaaacataagtgcttctgctccctccccttg

SEQ ID NO: 434253 - DNA, 8213 bp, Homo sapiens
tttgattatagggggcagtctgtctggaaattggtaaaacccacacattttatatgtgcttatatgtagttctattaagacctatgttaaactctggtgggataattccgtggcactttcacataatttaaattatgccatgtaagagtcactaaacccttatatacttcagtatgaatcctgtacattgcccaagaccttgttaagagaatgtaaattaaatataaattggagtatcagtgtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcattgtcccctattgtctcttactatttgtaaagtgaagactacgattagtctttttcatcgggatggtttgagatgaatacagaataggctcggcaatttggatactttaggcttttcaagaacattagtaacattttttttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatcttcatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcagctacagcctccgcttggcgtcccgatgctctccaccagcggccccgtacatcaccaggcagtataggaaggtcaaagctccggctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgaaccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccctttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaacaaattgggaaatggaaaaaaaatgggaagattaaaaagcacagggggaagaagaagagatttcggaggccatcctgccagggggggacggggctgactcctgctctctggaggacggtcagtccatgtctcggagaaacgggtgagctgagcttggcgtttggacccagttcagtgaggttcttgggttttgtgcctttggggcagactccagacaaggatgtctgagaccacttgggctctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtacgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcgattgtgaggaacaagcctgggagtga

SEQ ID NO: 434254 - DNA, 2736 bp, Homo sapiens
cggccgcgggcgccggggccggcgaaacagcggcggcggcggcggccctcggtgctctgaggcgctggcgcggcgggcgcggggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagctacagcctccgcttggcgtcccgatgctctccaccagcggccccgtacatcaccaggcagtataggaaggtcaaagctccggctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgaaccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccctttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaacaaattgggaaatggaaaaaaaatgggaagattaaaaagcacagggggaagaagaagagatttcggaggccatcctgccagggggggacggggctgactcctgctctctggaggacggtcagtccatgtctcggagaaacgggtgagctgagcttggcgtttggacccagttcagtgaggttcttgggttttgtgcctttggggcagactccagacaaggatgtctgagaccacttgggctctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtacgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcgattgtgaggaacaagcctgggagtga

SEQ ID NO: 434255 - DNA, 6674 bp, Homo sapiens
cggccgcgggcgccggggccggcgaaacagcggcggcggcggcggccctcggtgctctgaggcgctggcgcggcgggcgcggaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434256 - DNA, 6748 bp, Homo sapiens
cggccgcgggcgccggggccggcgaaacagcggcggcggcggcggccctcggtgctctgaggcgctggcgcggcgggcgcggggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434257 - DNA, 6609 bp, Homo sapiens
cggccgcgggcgccggggccggcgaaacagcggcggcggcggcggccctcggtgctctgaggcgctggcgcggcgggcgcggaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434258 - DNA, 6912 bp, Homo sapiens
cggccgcgggcgccggggccggcgaaacagcggcggcggcggcggccctcggtgctctgaggcgctggcgcggcgggcgcggaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaaacatctgtgaaaggactgcattttgtacataattgggagcagttagggggtaaaacaaggtgtgtgtggaggattgttcagagcccgcactctaatttaaaagtgcggcgtctactcagcccacctggcgtctgttcacttgtttctatttgacagtaactgaatatgtgctcattccagttggatttctatgtagagggtggacgtgtagtcagacaacggtgccgagaagtacctt

SEQ ID NO: 434259 - DNA, 6204 bp, Homo sapiens
acgctccctctgtggggggcccgtcacccggagccttcagctggcagctgctgctgacttgagtgagaaccagagagaggacggcagcgccaagccggagctgaaggacttcagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434260 - DNA, 5679 bp, Homo sapiens
tcaattaagtatataaagtagaagtaatttattgttcatcatcatctcccttatgttttaggtggtaagagaaataacttgaatcattcagattgttcaccaagtagctggtttcccatgcttcacttccatgcttctgcttccatgtgctttctaggtcctaaagaagacgaagagaagccttcagcctcagcacttgagcagccggccaccctccaggaggtggccagtcaggaggtgcctccagaactagcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434261 - DNA, 4411 bp, Homo sapiens
cggccgcgggcgccggggccggcgaaacagcggcggcggcggcggccctcggtgctctgaggcgctggcgcggcgggcgcggaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgatctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434262 - DNA, 2354 bp, Homo sapiens
gggttcatttccatgggctccagtaaagcagaaagggaaggaaagaggtgtattctctactcacctcctactcatctttcacctttgtaaaccccacggtgtttttgggttctttttttttttttttttttaatgagacagagtctcgctccgttgcccaggctggagtgcagtggcacgatcttggctcactgcaagctctgcctcccgggttcacgccattctcctgtctcagcctcccgagtagctgggactacaggtgcccgccaccatgcccggctaattttttgtatttttagtagagatggggtttcaccgtgttagccaggatggtctcgatctcctgaccttatgatccgcccgtctcggcctcctgcagtgctgggattacaggtgtgagccaccgtgcctggtgtttttgggttctttaatgcttcttttagagccacatttttcttttcaaaccgagttcccatcgcagtcaagaaaaaggtagagaagcaaaatgaaattctagaccaagtttttccatttaccaggaattgatttaaaaaaaaaagtgctaatttctcatgcctccatctctgctacatcccttggaaataaatgcgtgtagttccttgcagggtgtgtcttctgggtaggacgctcgttcctaaatgccttcagtcatgtatgtgttgtcgtcttaataacatttgtcttacggtctattcacctttttctttaacatggtcaatcatgtaaggttatgttctgttgtcatttatcttcagttttcttattttctaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434263 - DNA, 3232 bp, Homo sapiens
tttgattatagggggcagtctgtctggaaattggtaaaacccacacattttatatgtgcttatatgtagttctattaagacctatgttaaactctggtgggataattccgtggcactttcacataatttaaattatgccatgtaagagtcactaaacccttatatacttcagtatgaatcctgtacattgcccaagaccttgttaagagaatgtaaattaaatataaattggagtatcagtgtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcattgtcccctattgtctcttactatttgtaaagtgaagactacgattagtctttttcatcgggatggtttgagatgaatacagaataggctcggcaatttggatactttaggcttttcaagaacattagtaacattttttttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatcttcatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaa

SEQ ID NO: 434264 - DNA, 2773 bp, Homo sapiens
cggccgcgggcgccggggccggcgaaacagcggcggcggcggcggccctcggtgctctgaggcgctggcgcggcgggcgcggaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaagctacagcctccgcttggcgtcccgatgctctccaccagcggccccgtacatcaccaggcagtataggaaggtcaaagctccggctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgaaccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccctttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaacaaattgggaaatggaaaaaaaatgggaagattaaaaagcacagggggaagaagaagagatttcggaggccatcctgccagggggggacggggctgactcctgctctctggaggacggtcagtccatgtctcggagaaacgggtgagctgagcttggcgtttggacccagttcagtgaggttcttgggttttgtgcctttggggcagactccagacaaggatgtctgagaccacttgggctctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtacgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcgattgtgaggaacaagcctgggagtga

SEQ ID NO: 434265 - DNA, 752 bp, Homo sapiens
cggccgcgggcgccggggccggcgaaacagcggcggcggcggcggccctcggtgctctgaggcgctggcgcggcgggcgcggaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagctacagcctccgcttggcgtcccgatgctctccaccagcggccccgtacatcaccaggcagtataggaaggtcaaagctccggctgcagcccagttccagggaccattcttcaaagagtagacactctggctgctccctgacaggtacgaggcaggatggaacagctt

SEQ ID NO: 434266 - DNA, 2780 bp, Homo sapiens
cgcggccgcgctgcccctggcttcgcggaagccctgagtagcgcagcgccctcgccgcacgcaaggctgcagtcccgctccaggccagagtcccaggagagcgtcctccgcgctcacaggcgcctttgtcttcccgcttcccccttcctttttcaaaagccaagaggtaattatttggtctttgtgcaaggcaaacctctccagatgccacttccaaatataggctctcattaacaccagaggctggcctggtgtggtgcagggcggcccttccttctcctggcggacactgtgtccccgcgcgctggcgtgcaccacatctggaagccaggcgggcagggcagagaccccggctcctgcgcccctcctagctcccagagagcgtggatcgcgggcggggctcaccgagcgaggttacctctcttgaaaatacttaaacactttttttcctctccactgaaatctcaaaaaacagcccattttgaaccagaataatttagtctgacaacagattcttcctctgttcacagctgtcccagagggaggagctgaaatctgaacctctcagctgtgattggatctttcttgcaaaagagaggaaaaaaaaaccctcccagccaaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaatgaataatgcttattatgcatctgaagtgttattttatgtgttagatta

SEQ ID NO: 434267 - DNA, 1948 bp, Homo sapiens
  misc_feature (2)..(2): n is a, c, g, or t
anttcggcacagaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaatgaataatgcttattatgcatctgaagtgttattttatgtgttagatta

SEQ ID NO: 434268 - DNA, 523 bp, Homo sapiens
tgctggggccctgctttctctcccagccgattttgattacaagaactccttcaagccctttttgttctttttaagaatatgagtttagagggacagaggcaacaaatctgtattcattgctcaccgtagttcctgaatgaggccccacataatgtggagaccagctcatatcttgatctttgcttgtgaatgcctttacctttattaacaaactgagaaggggcagctgttggaagatttagagtgtggaaccacatttaccttttctcttccgctcagatgcctctgcctctggagcctggagatgtttcccctggttttgccttcgataccctctgtgatcttggattggtccttcgtctgtttccaccctccccctaccagcctcatatttctccttctgttaccttctgtatgctgtattggctctaaggtcttttcaattaataataaattggtgtatgtgcttctttgaatattctcatttagaagatgaatatatgttgacccccaacgatactga

SEQ ID NO: 434269 - DNA, 4392 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434270 - DNA, 4151 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434271 - DNA, 4355 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactcttttcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434272 - DNA, 4338 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434273 - DNA, 2825 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434274 - DNA, 2790 bp, Homo sapiens
tgaattctgtggtgccctatcattatgcaaatgtgactttgagaaagctagttaatctcttgttccctcatcgcaggggtgatgatgatgtgattcatggttcgctaaggtgctcaaggtttgagctccccagtggattatcagctgcatgaaaagaccttgtcagtcttgttcacccatgtgggtgtcctcagccctggaatagtagctggcagctagaaggtgctcagtgagtaatgtttggctggtcagatgaatgcgtgaatgaatgaatgtgaatgaggagtcttcagaaacactatagtcggttatgttatgatgctggtggtaacgtgtctctgagcaccctcaggagcttatgttttcctcctttcttgcaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434275 - DNA, 4627 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaaaaaaaaaaaaaaaaaaaaaaaaaaaacggcacgagctttgtcaagccagcagtcgtgacggtggggacttcccggaggaggactacgggttggacgagatatgacacctaaggaattcccctgcttcagctcctagctcagccactgactgcccctcctgtgtgtgccatggcccttttctcctgaccccattttaattttattcattttttcctttgccattgatttttgagac

SEQ ID NO: 434276 - DNA, 4339 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434277 - DNA, 1926 bp, Homo sapiens
ctttctagagcatacgtttggcgcgcgggtccagatatgtatatgtgaacataggtcagtagctgctttcactagagacgtagtacctgagtcactgtactagttggcgtgtgcgattacgtcagctcgaagtatagagagagactgcgccggtgaggatagcgaggcgatctgaatcgaaagtccagtatggcacgcttctgatggtcatgtagctggggactctactctatgcaggatgtcgcaagacgtatgctcgatatcacaatttacgcactccgtcgctctgcaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctatgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 434278 - DNA, 3061 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctg

SEQ ID NO: 434279 - DNA, 2221 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagagtctgcctctggagcctggagatgtttcccctggttttgccttcgataccctctgtgatcttggattggtccttcgtctgtttccaccctccccctaccagcctcatatttctccttctgttaccttctgtatgctgtattggctctaaggtcttttcaattaataataaattggtgtatgtgcttctttgaatattctcatttagaagatgaatatatgttgacccccaacgatactga

SEQ ID NO: 434280 - DNA, 2491 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagagtgaatgctccactcatgctccacttgctactagaccgagcagctccaaagctgcaacgctggctgaacgctcccaaagcttacggacaaggacaagcagcacgcaagctaaaggccacactcccacctaccactcgggctccccgcctggcaaaagcctggacaccacgccctacatctctgcgcgcggcagactgactgattcccctcttccgaccaagccctggcctgccccggcttaccgctcagcccccagacgactctctgcaccacccagttgtgcccgccttcactccgcggcatgacgccacccccgacgtgctgcgacgccctgcgccgcgctgactcgctggccccccaccctgcttgcgctggcggccgcgctcaccccttctccgttgcacctttgaccccagttcccctcattcagccagtcatccggcgctcggccccctcccccttccccgcaccacccggtccccccggcccaccgccttccccgacgccttg

SEQ ID NO: 434281 - DNA, 2080 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggtaggtctcatcctgtccagacctgggtactgtgatggactgctcctaacaacagcttcctagaaaagtcttgaatggacgtttttttgccgtctgtg

SEQ ID NO: 434282 - DNA, 2137 bp, Homo sapiens
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgctctgcctctggagcctggagatgtttcccctggttttgccttcgataccctctgtgatcttggattggtccttcgtctgtttccaccctccccctaccagcctcatatttctccttctgttaccttctgtatgctgtattggctctaaggtcttttcaattaataataaattggtgtatgtgcttctttgaatattctcatttagaagatgaatatatgttgacccccaacgatactga

SEQ ID NO: 434283 - DNA, 1797 bp, Homo sapiens
  misc_feature (1729)..(1729): n is a, c, g, or t
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaagtgttgatacagtgtaccagaatcctggcacgtgctttgcngtctgccaagtacatcaccaatcatgaatacctgggaacgctagtgtctttaggacatgggcagctct

SEQ ID NO: 434284 - DNA, 890 bp, Homo sapiens
  misc_feature (822)..(822): n is a, c, g, or t
  misc_feature (829)..(831): n is a, c, g, or t
  misc_feature (836)..(836): n is a, c, g, or t
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgggtcgatggcgtcngaggccnnnccaangatcgcgaggccctccacaaccctaacccacgcgcacccacccccacggaaaca

SEQ ID NO: 434285 - DNA, 4608 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434286 - DNA, 807 bp, Homo sapiens
gaaaaattgccaagcaaaataatggtttaaacaagattggaaggaacaatttaaaagcactcatgtgtaattgatatgtcaattactaatcattcctctattcattaaacccagtctcctaaggatacctattttctttatgaatatttgaaatgtgtaaaatggccctatttttaacagactgattctgggttttacacatttggataagctttcaaatctatctaatttgtgtttataaaacattgccatcctgtgtgtatgtatatgtatatgtatattttttcactggttatgttttttttcagccttcgttcagaaaaacctggtctatggcacaactaaaaaggtttgccgcagacccaaatacgtgtctccccaggatgtgacgaccatgcaaacctggtaggttgcagtggggggcttggtacttaggatgtaaccagctggggtgtgctctgcagtggtgacagaaaacctgcctcagacagcacccgggcaccgttggcttgtacaacgaagtgctcccacactctgttatcgtttgtcttctactagttggaccagagtgggaattaccctgtgggtagaagcttcgtgatgcataattagaaggctgcctgttgtgatctgcgatgattctctggagaagacagactctgaaggcgagtctagacttgaagccaacccatccgtttgtcttttctgtggaatcattgagtcatagacttgaattttttaaatgttgaaataatgaaataatgatggaattacaccaataaaaactcatgtattttagtatttgaa

SEQ ID NO: 434287 - DNA, 477 bp, Homo sapiens
  misc_feature (10)..(10): n is a, c, g, or t
  misc_feature (12)..(12): n is a, c, g, or t
  misc_feature (14)..(14): n is a, c, g, or t
gacttttcangngngggtgatcagatctgtttgtaccatatccggaaaagttgtagctttcaaggaagaactgtaggaatagtcacagcttgacaaccgaacacaacctgagtgtgctgagaactcatggcgttgaccacctgagctataatgagctatgccaactcttgtttcagaacgacccctggcttttgccagaaaaatttggaatgtggagcagaaggagcagtgaagttcaagggccagctttgccaacaacccagttccacaaacatcacacagatgccatggatagctgtgcgactagggctgattctttaacttctctgagcctctcagtgtgctccattgagaaatgaaagggtggtatttggccttctctaagatgctttaagccctcagagcctctttgactttgaattgtagaaaagagagctcagagaaaactggggcttggggaagggagagttgatgagt

SEQ ID NO: 434288 - DNA, 4201 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaaaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434289 - DNA, 2248 bp, Homo sapiens
  misc_feature (10)..(10): n is a, c, g, or t
  misc_feature (12)..(12): n is a, c, g, or t
  misc_feature (14)..(14): n is a, c, g, or t
gacttttcangngngggtgatcagatctgtttgtaccatatccggaaaagttgtagctttcaaggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaaaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434290 - DNA, 2603 bp, Homo sapiens
tagagtgagggatgtaatagctgtgttctgtgtggatgatggaatcacagcttgtgaagcccctttctcaccagtggactggccactggggaggtggtgtcgtgtgagaccttcctgaactggtggttttttccctctctgtcaacagatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434291 - DNA, 4157 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcaggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434292 - DNA, 4766 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaaaaaaaaaaaaaaaaaaaagggggggggctaaaaatccccgggggcccagttaccgtgccgtttctggcaaggggcccaaaggggtataagaagcagggcgggtaacaccgtgggaacggctggcttgggggccctggggtggaaccccaaagcggaat

SEQ ID NO: 434293 - DNA, 1901 bp, Homo sapiens
gaaaaattgccaagcaaaataatggtttaaacaagattggaaggaacaatttaaaagcactcatgtgtaattgatatgtcaattactaatcattcctctattcattaaacccagtctcctaaggatacctattttctttatgaatatttgaaatgtgtaaaatggccctatttttaacagactgattctgggttttacacatttggataagctttcaaatctatctaatttgtgtttataaaacattgccatcctgtgtgtatgtatatgtatatgtatattttttcactggttatgttttttttcagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434294 - DNA, 1520 bp, Homo sapiens
cactaatgggcgagcttcgtcaggcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 434295 - DNA, 3361 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgttggaccagagtgggaattaccctgtgggtagaagcttcgtgatgcataattagaaggctgcctgttgtgatctgcgatgattctctggagaagacagactctgaaggcgagtctagacttgaagccaacccatccgtttgtcttttctgtggaatcattgagtcatagacttgaattttttaaatgttgaaataatgaaataatgatggaattacaccaataaaaactcatgtattttagtatttgaa

SEQ ID NO: 434296 - DNA, 3514 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctggtaggttgcagtggggggcttggtacttaggatgtaaccagctggggtgtgctctgcagtggtgacagaaaacctgcctcagacagcacccgggcaccgttggcttgtacaacgaagtgctcccacactctgttatcgtttgtcttctactagttggaccagagtgggaattaccctgtgggtagaagcttcgtgatgcataattagaaggctgcctgttgtgatctgcgatgattctctggagaagacagactctgaaggcgagtctagacttgaagccaacccatccgtttgtcttttctgtggaatcattgagtcatagacttgaattttttaaatgttgaaataatgaaataatgatggaattacaccaataaaaactcatgtattttagtatttgaa

SEQ ID NO: 434297 - DNA, 2430 bp, Homo sapiens
tctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaaaatttggaatgtggagcagaaggagcagtgaagttcaagggccagctttgccaacaacccagttccacaaacatcacacagatgccatggatagctgtgcgactagggctgattctttaacttctctgagcctctcagtgtgctccattgagaaatgaaagggtggtatttggccttctctaagatgctttaagccctcagagcctctttgactttgaattgtagaaaagagagctcagagaaaactggggcttggggaagggagagttgatgagt

SEQ ID NO: 434298 - DNA, 640 bp, Homo sapiens
tttccgtctgaggcagcgatggcaaggggtcaagatggacagcagccagtggtagacttgtggatttaaatgtacaggtgacagcttctaactcagatttccatttgacaaggctcataattctatacattgggctgccagagtctacagactgcttccgtatatgggatctcattcattttccatgccaaccctgtaaggttgggctgaacagccccattttatgcctgaggaatctgaggtttgggggattaagtagtgacgtgtccacaggcctttaggtttcgtggggcagatccggaacttgaaaggaatttgctatctcagtttggtaactcctcagatgctgccactcagaagggtgttggtatcactgatgcatgtgacttcatgagggagagtggagacatggcacagagggagggagggagatgcggggtggaagagtagaggccctggcgttgcacatcaccaggacgctattcgcagtgtgctgacccttcctggctgcaggcccctccaccagctgagccctcgtgtgtcatttcagggagctactttgcccgagatgctgcatattcccaccactacagcaaatccgacacgcagacccacacgatgttcctggcccgggtgctgg

SEQ ID NO: 434299 - DNA, 245 bp, Homo sapiens
cgagtctagacttgaagccaacccatccgtttgtcttttctgtggaatcattgagtcatagacttgaattttttaaatgttgaaataatgaaataatgatggaattacaccaataaaaactcatgtattttagtatttgaatatcacggaataccaaaactctaaaaacagatattgcagtcactaatgggcgagcttcgtcagggtgagtttctttcagtcccaagatggctgccaggagccac

SEQ ID NO: 434300 - DNA, 374 bp, Homo sapiens
ctagtgtttacaagaagctttgggaagggactgatttatattctgcacgttgatggtaatgcattaaaaacatttgccccttgcagaagatcacccttagttcttcctcggaagagtatcagaaggtctggaacctctttaaccgcacgctgcctttctactttgttcagaagattgagcgagtacagaacctggccctctgggaagtctaccagtggtgcgttggggctcgctcttggtgggctggtgactctgtcccttcacaccactggctggttgccacatgtggcccgggtttccaggaaaagcagagcggcagttagggctgccatgtgctgggagctgtgtgtctgctctccttcgtccgctccccc

SEQ ID NO: 434301 - DNA, 2535 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaa

SEQ ID NO: 434302 - DNA, 2621 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcaggtgagcccgcgggctcgcccgctgcggaatggttcggaaccccgcgctcccggacctcgccgtctccctcgtccgccgcaagccagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaa

SEQ ID NO: 434303 - DNA, 2457 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaa

SEQ ID NO: 434304 - DNA, 2330 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcaggtgagcccgcgggctcgcccgctgcggaatggttcggaaccccgcgctcccggacctcgccgtctccctcgtccgccgcaagccaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaa

SEQ ID NO: 434305 - DNA, 2481 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaa

SEQ ID NO: 434306 - DNA, 2586 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaaaaaaaacacaaaccaaacaaaaaaaggggggggcgcccaaaaggtttcccg

SEQ ID NO: 434307 - DNA, 1954 bp, Homo sapiens
tttgactggagtatggggaaaaggtggggcgttggggagacaggtctggggccagactgcaggggtgggaattggcttggtctgggaggcaatgaggggcgagtggacgggtcagaggcggcggcgcttccaccccgactggcattagagggcgtgtcctaggagaggagcatccccctccccggaccagccgccctccggagcccagagtcaccggagatgggggcacaccccggggctgcgtgtgtcgtgtcaggccgcggcagggagaggccgtcccctggtggcgccggccggaacgcccctcgtgccgcgaccgcgcgcccctctgtcctcgccgcgcgtcggcgcagagcagccacccggggcccagcaggcgcgggcttccccacgcgccccgggaagggacagctcggtgtggggtccgggaggcttgagccccgcggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacatgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaa

SEQ ID NO: 434308 - DNA, 436 bp, Homo sapiens
cggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcggagtgcagcgcagccgcggggagcgaggagcgcgcggagccggccatgggcaagtcaggtgagcccgcgggctcgcccgctgcggaatggttcggaaccccgcgctcccggacctcgccgtctccctcgtccgccgcaagccaggtcctggggagtgcgggagcccggggtgcgggtggagggcgcgcgggcggagcgccccggcgcggtttccggggaacccggggggaaggcgagc

SEQ ID NO: 434309 - DNA, 621 bp, Homo sapiens
aactcaacactgaacacaaatgtggtgctttgtttatgcagtgaaacattttggagacctgcaaaaggaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434310 - DNA, 1256 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434311 - DNA, 1154 bp, Homo sapiens
gagactagttctctctctctctcgtgccgaattcgcggaatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434312 - DNA, 709 bp, Homo sapiens
atcattaaccagtctttactactaaacttaaatggccaattgaaacaaacagttctgagaccgttcttccaccactgattaagagtgggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcacctgagcagtgaatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttttgaagaggtgaaaagaatttagattcttttcacctcttcaaaaagcgatgctacc

SEQ ID NO: 434313 - DNA, 184 bp, Homo sapiens
aagggccggccccaggagcaggagggggtggggaggatccaaagaagcagaggaccaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434314 - DNA, 1292 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacaaaaaaaaaaacaattcccctctatatcaaaaaaaaa

SEQ ID NO: 434315 - DNA, 1881 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacaaaaaaaaaaaaaaaaaaaaaaaaaaaaaaaaaaaaaaaaaacaaaaaaaaaaaaaaaacgaacgagaaaaaaagaaagcaggagagaagcacagagagaaagagagagaaacgaaagaaagaggacgaagcaggagaaggaacaagagcagagggggcggggagggggggggggacaggaggacgggccgcgggagcgagaacgaaggaggggagacaggaaagagagagaggagaggagagagagaggagagacgaggagagaagagaggggaggagaggagaggcgaagagaggagagaggacgggagcgagtacgagagagagagacgagggggcagacggaagagggcgaaagcggaccacgacagggagaagaagaggagagggggaggggggaggaaagaagaagagaacgtgaggtgagacagagtagtcgacagaaggagcgggacgagaagacaaaggaggcggggtagtgaaagcagcgcaagaaggaaggagagggaggagtgggaagagaggaaagacgcagaagaggagaaaggaggatcaagggaaggagagaagaaagagaacagggagtaaggagtagacagagaggagaataagaggagggggaaggg

SEQ ID NO: 434316 - DNA, 1202 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcattatttcaagtctaataaattcttaattaacaaaca

SEQ ID NO: 434317 - DNA, 1569 bp, Homo sapiens
ccacgcgtccggcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctaccttttttttaaaacaaaaaggtagatttaatgcagcatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434318 - DNA, 1896 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtctgaaaaatgagtaaagatggaagccaaagtatcacttttattgtggtttgtgagaggaagctgggcccatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggcctaaggctgcttgcacttgtggcagaaggatgaagatggtactacgacattcatgatggatctgccaccataacccaggcacctcccattagaccccacctccaacattggggatcacatttcaacatgagttttcaagggacaaacatccaaacatccttagcaggttgactaaggggacagaaagaagcctggagttgtactacctgaacttctcacagtagggagatgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434319 - DNA, 2052 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggcaccttactagggatatgaaggtgagaagaagagctgattcctgctgtcaagaagcatagagtccaatggcattatggtatgatgtgccgcatgttaggttgggtgttcttgcttttggatgggatcccaaataaatagcatccgttttttccagtctgaaaaatgagtaaagatggaagccaaagtatcacttttattgtggtttgtgagaggaagctgggcccatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggcctaaggctgcttgcacttgtggcagaaggatgaagatggtactacgacattcatgatggatctgccaccataacccaggcacctcccattagaccccacctccaacattggggatcacatttcaacatgagttttcaagggacaaacatccaaacatccttagcaggttgactaaggggacagaaagaagcctggagttgtactacctgaacttctcacagtagggagatgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434320 - DNA, 1334 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggcaccttactagggatatgaaggtgagaagaagagctgattcctgctgtcaagaagcatagagtccaatggcattatgtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434321 - DNA, 1382 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggtgatgaacagcctccttctaaatcattgaccacatttcttattctttcctgaggataaatttcaagatatcctgaaccaactgatgacagcctatttagctacaggaatactctggaaggaaatgtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434322 - DNA, 1177 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434323 - DNA, 1053 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434324 - DNA, 1078 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434325 - DNA, 1989 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtctgaaaaatgagtaaagatggaagccaaagtatcacttttattgtggtttgtgagaggaagctgggcccatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggcctaaggctgcttgcacttgtggcagaaggatgaagatggtactacgacattcatgatggatctgccaccataacccaggcacctcccattagaccccacctccaacattggggatcacatttcaacatgagttttcaagggacaaacatccaaacatccttagcaggttgactaaggggacagaaagaagcctggagttgtactacctgaacttctcacagtagggagatgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccgaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434326 - DNA, 1188 bp, Homo sapiens
taaatgtagtctctttgaacccataaatttagtacaaaacctactaacattataccatgaatatattttctttgtaaacctggcttatcaaggaaataatttaaatctgtgagtagataatgttaaagtaaactggtttaaaagtgactaattcaataagttagtatcaaatatataaaaatgatctaaatttgacttttagaaaaaattcacattgatttttgtatataaataacatctatactttctcagaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434327 - DNA, 1270 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggcgatgctaccacctaatagttttcaaggaaaagtggcattcattactgggggaggtactggccttggtaaaggaatgacaactcttctgtccagcctaggtgctcagtgcgtgatagccagccgaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434328 - DNA, 1205 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggtatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434329 - DNA, 946 bp, Homo sapiens
  misc_feature (875)..(875): n is a, c, g, or t
  misc_feature (929)..(929): n is a, c, g, or t
  misc_feature (934)..(934): n is a, c, g, or t
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaactcttgcagctgaatgggggtaaatatgggattgcggattccaattgtggattccaaccaggggccttnttaaaaacccaaaggtgccttttagcccgtcttgggaccccaactggggaaccnttttngaggaaaaggaa

SEQ ID NO: 434330 - DNA, 1469 bp, Homo sapiens
ccacgcgtccggcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctaccttttttttaaaacaaaaaggtagatttaatgcagcatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434331 - DNA, 708 bp, Homo sapiens
gtacagtagagtgactaagggtacagactgaagctagacctcttgagattgacaaattggccatatgacatagagaaaatgatttaacctctctgtgccttagttacattatctgtaatatagggaacaataatagtacctacctgttggggttgtaatctctggcatgtagtaagcatctagtgagtctcagttattactgtctttaacatatggtataatatttcagaatgtatgttgttgattttaatttttagggtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaaca

SEQ ID NO: 434332 - DNA, 1466 bp, Homo sapiens
ccacgcgtccggcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctaccttttttttaaaacaaaaaggtagatttaatgcagcatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggtctcttgcagctgaatggggtaaatatggaatgcgattcaatgtgattcaaccagggcctataaaaaccaaagagtgtgtttggggcagggaggtctgttgtggaaccaatcctgacaatgctgaatgtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacaattcattgaatatgtattatgtgccaggccagtgatagccattgtatattcaaagataaataaaatgaaatatagtccttcaaaacatt

SEQ ID NO: 434333 - DNA, 1624 bp, Homo sapiens
acgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtctgaaaaatgagtaaagatggaagccaaagtatcacttttattgtggtttgtgagaggaagctgggcccatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggcctaaggctgcttgcacttgtggcagaaggatgaagatggtactacgacattcatgatggatctgccaccataacccaggcacctcccattagaccccacctccaacattggggatcacatttcaacatgagttttcaagggacaaacatccaaacatccttagcaggttgactaaggggacagaaagaagcctggagttgtactacctgaacttctcacagtagggagatgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggtaagtcccttacatcaagcctattggcgacgcttttgaagaaactgttctgtgccatagtattgaaaacactgttcgccagagttgtttgattagcatcttaatcttatatgaaatactagaaatattatttagattatttaaatacatctttttggaaaaagttaggtactatttgagatgaaagaaacaatgaaaattgtggaactgatgtttgggtaaacatccgcaattttcattattttaatttctccaattcagtggtagaatatttctttttctgtacacgaagatgaagttaaaaagtacgacatggagccaggtgggatggtgtgtgcctgtaatcccagctactgggaagctgaggcaggaagatcacttgaagcccagaatttgagaccagctgggcaacatagtgagaccttgtctcaaaagaaacattttttttttaagcactatatggaggttgctttgtcttcagtgggagtgattatggttactgctttaattaataattaaccttataccaggaaaattgatgcagtactttcattttattttttattttttg

SEQ ID NO: 434334 - DNA, 489 bp, Homo sapiens
tcctgaaccaactgatgacagcctatttagctacaggaatactctggaaggaaatggtagcttctggagttttaactggagtgttaatcttgccaccatgacctaatggaatatcacataacctccctggtgtgaccattaagcttagcaggatctcagagaatagacagaggaatatgcaagctggttatcagagaaggctctggagcctgtcagtcagtttgaaccttggttctgcaactttggcaatatatatattttttatcactctgagccctttctgtacaataggataaaactaatacctatttcatgtggttgtttggaagattaaatagtttgatatgtaatcctggcaggtggtaactacttaatgaatgttagctcctattgttcattatattagatacctaaagtttgttttatgattaaatgcgagagaatggcagtgatgttcgcatgtaatgtgagtacaagctgttaacatat

SEQ ID NO: 434335 - DNA, 692 bp, Homo sapiens
gacagcaggggggagttgcccccaggttcctgaccagtcctcctacggcttatagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434336 - DNA, 1584 bp, Homo sapiens
cccacaactggttagggatacagtctggactaaaacagaggtgttcggtgttctgcctcccaggtttcttctctgaaggagtccaggtgagctgggggtaggcccagccctaccacagttctgagtttgtccataagggcacgagatgggaggtggtcttgggttctcaggtgtcttgagaataaggagcaattgttgccattatgccttccctgccataggaaactcattcagcaacattgaatgcttgctatgtcccaggtatggcagataggagggatcaaggcagaagaggtcttgctctgggggttgagggacaggggaaaaggagccagagagcagactccagcttcagagctctgggagctgtcagttgcttaataggcacaacccactcactccagagtggggaaaaggctttgccaacacccagaactgggggcctgggtcccatgcggcctagcctgcacttactaagccgtggggcttgaaacaaatggctcctctgctctgtgactcagtttccttatctgtgaagggcagctagcattctgaaggatggccagaagggtggtccccccgagcatggcatagatggtccattggtattggctgggatcctcatctgcctcctctgctctacccaaggcaggtgataagggttagagaacccctctgctgcccacacgttccctggcctccatctccagcagcagggttatccccaccccctgtcaaagaataggggtccctgggcctctcaacaggaagtaccagatcaggcagctagcagacaatcatcggtggaccacagggccactagagtgagacctatccatagataaagattggccagtgatgaagcccatctgggtgcaaaggccgagctgagaggcttctaccaactggagtgtgccagtgagggtgagcagaaggtggtctccagggagaacatgggcagggtttggagccagcacctccccagggttggaggaagcagacccaggacctgcctgactgggatggggctctcttctgccatctccgcctccacctgcctagctctgctcccccgccccgagagatgcctccaggcttgggtagatgaagccaggggcttcctgccttcctggaaggcttttccctgtctggagtttatgaaagaccagcaggcaatgcggcaataaaaaagaccttggggtagaggggcgccacgagaggcgggtctggcgctgacatccaaccccgtgccccctccctgcaggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434337 - DNA, 3390 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434338 - DNA, 1416 bp, Homo sapiens
gaggtggggggcaggcctggggccacacattagtcagtcaccatacattaactaagcatccacagtgtgccagaccagggcccctcaaattccagacagacattagttggggctacaggaggaaggagagatctgcgctgggaggctgggccaggatttaggggtccattttgatgggcagcactggggcaagatggggctcttgcctctgtcactgagagtgttccaggcccttgagggcactttggaagggagcttcggaagccggagatgacgaagattttgattacatccttctctgccctctaagtctttggcttcctccttgctcagtgacaaatccttggccctctccaatcttctcagtttgcctgaaatccaggggttgggcaggtcagcttctgaaagcccttccaggtggggaattgaattctgtatgaattggcaggaggtgctgggtgcctggacacctggcttcaggaggtctggacagcagagctggctccaagaatcggaagacacagtgtaccttcctatacctgggggaatgacagtggtggtggcagcaagaactacgggttcagcccacagccagaagctgagcctgcggagtgggtgggggctgggtaggccctgtggatgggtgggtggggcaggaaactggagactggagtgcaccccctggtggtaagcacagcttgggtgggtcttgccaggccctggcttctcaatccaggtccctgccctccctgttttgaggtttagacaggatgagagtccatcccaggccacacagcagactggcggccaagctggcagggctggaaccagagaccccctaccctgggtttggtgagttttccagcaaaccaccctagggcagagggcagcttccagccaggagccacattataggatgggacagtaatggacgctcctaggttagagagggaaagtaaggcacagagcctaagtgcctgtggtttctggaagccccagcatgcctgattcatgtctgtcccctgcagaaattctctgagctggtgacaggtgccacaggcactggggatctcaccagaaaggaaccgacggagctaggggccagcgagatggcggacgaggccttagctgggctggatgagggagcccttcggaagctggtaagtggccccatcacccactgtggggacaggaaagccaagccagagaggcagggtcaatccagggtacctctcagctgacaggaagaagtgatgggggaaaggtcaggaggagggggacatgggaacaggggtaggccagttccatgtggctgatgcagaggcccttgtggcatgtgcctgtccatgcctggtactgaagcctagtccctcccaaccctccacagccaccacctgtttaaacagtaactgctgt

SEQ ID NO: 434339 - DNA, 1464 bp, Homo sapiens
gaggtggggggcaggcctggggccacacattagtcagtcaccatacattaactaagcatccacagtgtgccagaccagggcccctcaaattccagacagacattagttggggctacaggaggaaggagagatctgcgctgggaggctgggccaggatttaggggtccattttgatgggcagcactggggcaagatggggctcttgcctctgtcactgagagtgttccaggcccttgagggcactttggaagggagcttcggaagccggagatgacgaagattttgattacatccttctctgccctctaagtctttggcttcctccttgctcagtgacaaatccttggccctctccaatcttctcagtttgcctgaaatccaggggttgggcaggtcagcttctgaaagcccttccaggtggggaattgaattctgtatgaattggcaggaggtgctgggtgcctggacacctggcttcaggaggtctggacagcagagctggctccaagaatcggaagacacagtgtaccttcctatacctgggggaatgacagtggtggtggcagcaagaactacgggttcagcccacagccagaagctgagcctgcggagtgggtgggggctgggtaggccctgtggatgggtgggtggggcaggaaactggagactggagtgcaccccctggtggtaagcacagcttgggtgggtcttgccaggccctggcttctcaatccaggtccctgccctccctgttttgaggtttagacaggatgagagtccatcccaggccacacagcagactggcggccaagctggcagggctggaaccagagaccccctaccctgggtttggtgagttttccagcaaaccaccctagggcagagggcagcttccagccaggagccacattataggatgggacagtaatggacgctcctaggttagagagggaaagtaaggcacagagcctaagtgcctgtggtttctggaagccccagcatgcctgattcatgtctgtcccctgcagatcttcttgagccttgtgaaccaaggggccccaaccaaggccaaccttggggagattctccaacccaaggaaagggaaccaggaccgggaggtataggggcccaagccgaagaattgccggaaccgaaggccctataccttggccttgaagaaggagaccctccgaaacttgtaagtggcgccccaacaacccaccgtggggaccaaggaaacccacacaccaagaagaggcagggtcaatccagggtacctctcagctgacaggaagaagtgatgggggaaaggtcaggaggagggggacatgggaacaggggtaggccagttccatgtggctgatgcagaggcccttgtggcatgtgcctgtccatgcctggtactgaagcctagtccctcccaaccctccacagccaccacctgtttaaacagtaactgctgt

SEQ ID NO: 434340 - DNA, 417 bp, Homo sapiens
  misc_feature (6)..(6): n is a, c, g, or t
ccctcnctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccccacatacacacgcagcgttttgataaattattggttttcaacgaaaaatgaaaaa

SEQ ID NO: 434341 - DNA, 3225 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434342 - DNA, 4593 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434343 - DNA, 4515 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434344 - DNA, 4801 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagagtaaggccacctggtgtcgccctgtgcctgcctgcctgtccgcccacctcctccggctcttccttgagctctctctccgtgtcttcaactgtgccgtcactttctcttctctgcctgcggctatcaccacccctccatacagcctcccatcccatctcctgatgtccagcccaggccctcacctggtgccccttccccttttttgcagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434345 - DNA, 3598 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagagtaaggccacctggtgtcgccctgtgcctgcctgcctgtccgcccacctcctccggctcttccttgagctctctctccgtgtcttcaactgtgccgtcactttctcttctctgcctgcggctatcaccacccctccatacagcctcccatcccatctcctgatgtccagcccaggccctcacctggtgccccttccccttttttgcagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434346 - DNA, 4273 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434347 - DNA, 3162 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434348 - DNA, 3778 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgcagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434349 - DNA, 2603 bp, Homo sapiens
tccttgtaatccaagcagtcggatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434350 - DNA, 3628 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatgcacacgtacgcccacaagccgggatcgctcgtagagtcggcgcggcgaggcgagcgaagcgtggaagtgcgtgatgaagcgaggggggagg

SEQ ID NO: 434351 - DNA, 1001 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccgtagcatgtacttcacccgtagctgtacctcaccagtagctgtacctcacccgtagctgtacctcacccgta

SEQ ID NO: 434352 - DNA, 1244 bp, Homo sapiens
cccacaactggttagggatacagtctggactaaaacagaggtgttcggtgttctgcctcccaggtttcttctctgaaggagtccaggtgagctgggggtaggcccagccctaccacagttctgagtttgtccataagggcacgagatgggaggtggtcttgggttctcaggtgtcttgagaataaggagcaattgttgccattatgccttccctgccataggaaactcattcagcaacattgaatgcttgctatgtcccaggtatggcagataggagggatcaaggcagaagaggtcttgctctgggggttgagggacaggggaaaaggagccagagagcagactccagcttcagagctctgggagctgtcagttgcttaataggcacaacccactcactccagagtggggaaaaggctttgccaacacccagaactgggggcctgggtcccatgcggcctagcctgcacttactaagccgtggggcttgaaacaaatggctcctctgctctgtgactcagtttccttatctgtgaagggcagctagcattctgaaggatggccagaagggtggtccccccgagcatggcatagatggtccattggtattggctgggatcctcatctgcctcctctgctctacccaaggcaggtgataagggttagagaacccctctgctgcccacacgttccctggcctccatctccagcagcagggttatccccaccccctgtcaaagaataggggtccctgggcctctcaacaggaagtaccagatcaggcagctagcagacaatcatcggtggaccacagggccactagagtgagacctatccatagataaagattggccagtgatgaagcccatctgggtgcaaaggccgagctgagaggcttctaccaactggagtgtgccagtgagggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434353 - DNA, 137 bp, Homo sapiens
ggcaggtgaagacctggactccacagcccaacacccgcgacctgtctcttacccacagttgcgaagcgctggtgagtatgaggagcgcaagctgatccgagctgccatccgccgtgtacgggctcaggagattgagg

SEQ ID NO: 434354 - DNA, 3483 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaaggctgccgaggatgccgggacccccgtggcccacccacctgccttcagcacccgccgccgctcctccaccggcaccacccgcagcactagtctcatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434355 - DNA, 5400 bp, Homo sapiens
gaggtggggggcaggcctggggccacacattagtcagtcaccatacattaactaagcatccacagtgtgccagaccagggcccctcaaattccagacagacattagttggggctacaggaggaaggagagatctgcgctgggaggctgggccaggatttaggggtccattttgatgggcagcactggggcaagatggggctcttgcctctgtcactgagagtgttccaggcccttgagggcactttggaagggagcttcggaagccggagatgacgaagattttgattacatccttctctgccctctaagtctttggcttcctccttgctcagtgacaaatccttggccctctccaatcttctcagtttgcctgaaatccaggggttgggcaggtcagcttctgaaagcccttccaggtggggaattgaattctgtatgaattggcaggaggtgctgggtgcctggacacctggcttcaggaggtctggacagcagagctggctccaagaatcggaagacacagtgtaccttcctatacctgggggaatgacagtggtggtggcagcaagaactacgggttcagcccacagccagaagctgagcctgcggagtgggtgggggctgggtaggccctgtggatgggtgggtggggcaggaaactggagactggagtgcaccccctggtggtaagcacagcttgggtgggtcttgccaggccctggcttctcaatccaggtccctgccctccctgttttgaggtttagacaggatgagagtccatcccaggccacacagcagactggcggccaagctggcagggctggaaccagagaccccctaccctgggtttggtgagttttccagcaaaccaccctagggcagagggcagcttccagccaggagccacattataggatgggacagtaatggacgctcctaggttagagagggaaagtaaggcacagagcctaagtgcctgtggtttctggaagccccagcatgcctgattcatgtctgtcccctgcagaaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434356 - DNA, 2889 bp, Homo sapiens
  misc_feature (47)..(47): n is a, c, g, or t
ttggatgaggaggaagaggagaagtcttggtttgcatcatggtcctnccactgccatctctcttcctttgtcggagctcacgaagtgcagcccggatgagcttccgctcttcaaagtccgtgctctgatccagcatcttgtccaagactcattcattcccaagcccaggatccactagccgggagctcagccgggaaagggatccccaagcgggccacccggctgcccagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434357 - DNA, 3871 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactcgcgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaatgaaaaa

SEQ ID NO: 434358 - DNA, 1012 bp, Homo sapiens
tctggtatgccagaagacttagaagttattttgtttgcttgttttgtttgggtatttggggatttttaaaaaataatcaaagtggagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgccattaaaggagctgttcagctcctttaatggcagtggcatgaacatggctcactgaaacctctgccttctgagctcaagtgattctcctgccattaaaggag

SEQ ID NO: 434359 - DNA, 1426 bp, Homo sapiens
cgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 434360 - DNA, 1381 bp, Homo sapiens
gcggtgcgcgcgcctcttcgcggtccactgccgctgatgctcaagaccgtcggctgggagttgaggtcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 434361 - DNA, 1735 bp, Homo sapiens
cgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctaaaaaaaaaacaaaaaaaaagacacaacaaaaaaaacgagaaacaaaaacagggggggcacgcctcaaaaagaacaccccaagagggccacacaaagtacggcgcgaacaccacgcacttgctggtgcacaacggtgtggccccccatataaagagaccgtatatcaaaaacagagcgcgacaggggcggcggcgtaaaacaaacgcgcggacgacatcggggaaacacgagcgacagcaggcagactggtggaaagggaccacaaaaatgcgtgggcgagggaacacacacgggagcgcgaaatgacca

SEQ ID NO: 434362 - DNA, 1549 bp, Homo sapiens
cgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggcaaaatggctcattcctgtaatctcagcactatgggaggcccaagcgggaggatcgcttgagcccaggagtttgagaccagactggcaacatagtaagactccatctctacagaaaaaaaaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 434363 - DNA, 1542 bp, Homo sapiens
cgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagctggagtgcactagcgcaatctcggctctccgcaacctccacctcctggattcaagcgattctcctgcctccacgcgattctcctgcctcagcctcctgaatagctggaattacagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 434364 - DNA, 1264 bp, Homo sapiens
cgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 434365 - DNA, 542 bp, Homo sapiens
tgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctccctcctgatgtgtttcttcctctttgaagactttctggaactccctcaatacagttaaagtatctt

SEQ ID NO: 434366 - DNA, 2900 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434367 - DNA, 1144 bp, Homo sapiens
  misc_feature (8)..(8): n is a, c, g, or t
gcgagtantgggatatgtcgaccaggcgtcttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434368 - DNA, 970 bp, Homo sapiens
  misc_feature (89)..(89): n is a, c, g, or t
  misc_feature (94)..(94): n is a, c, g, or t
gaagcaagagagagagcgccgagtgacaaacattctggaccctagctaccataactgtatgggtggggagggaagaacggtcgtcctcnctctnttcgaatctgtaacgtaattccacttacagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgaaaaaaaaaaaaaaaaaaaaaaaaaaaaaaaaaaaaaaaaaaaaaaaaggggggggggggccctaaaaattacccccccgagagggggagcccaccaattttaagcacgactaccaccctagttttttttgtgtaccaagagggcgccccccccaaagaggaggacagcgcatataatataaaacggagaggcaaggggcgcgccggttttaaaacaacgcgcgggcaggagggggaaaaacggggccacgcggagaacaaccttgcggaaaaagaaccgccccactgcgggggggggacacatgggcggacaaactcccccacgagatatattagcccgagagaaaaacaacactgacggctaaagggga

SEQ ID NO: 434369 - DNA, 569 bp, Homo sapiens
gattcttcctctaattagattttattgttgaagttccttcatatggaagatattttccatagtatttggataagctgaactgtgttttaagaactcatatggatgttgaaggttgttttcagtttatctttccagggaacttctgttcagctctgagtgggtctggtcctttttcatgcctgagggagcagatgtgattgcctgtgattgaagccagtggagagttataaactatttttgttctaacatggatgatgcctaaactcttccactcttccacactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatggtaagactcttaaatccaaaaaccagtgtgacagcacagtaggagtcttgacccacctatgctaaccagagcacttggaaactaaatttaaagaaagtcaactgggacaaaaggagggaacacag

SEQ ID NO: 434370 - DNA, 2813 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434371 - DNA, 2852 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagtgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434372 - DNA, 2747 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434373 - DNA, 2594 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434374 - DNA, 2851 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctagctgtgctgtacctgcttctctgcctctccacctcatcaccctcctttatcactggattattttaaagcaaatccctggtcatcatgttactcacaaatatttcagaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434375 - DNA, 2628 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434376 - DNA, 2632 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgaaaaaaaaaaaaaaaaaaaaaaaaaaaaaaaaaaaaaaaaaaaaaaaaggggggggggggccctaaaaattacccccccgagagggggagcccaccaattttaagcacgactaccaccctagttttttttgtgtaccaagagggcgccccccccaaagaggaggacagcgcatataatataaaacggagaggcaaggggcgcgccggttttaaaacaacgcgcgggcaggagggggaaaaacggggccacgcggagaacaaccttgcggaaaaagaaccgccccactgcgggggggggacacatgggcggacaaactcccccacgagatatattagcccgagagaaaaacaacactgacggctaaagggga

SEQ ID NO: 434377 - DNA, 2264 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaattctaaagcctttaatttttggtcaaaaaagccataatcaacggggctttgtttctcccgcctcgtttttaagagcgttgactct

SEQ ID NO: 434378 - DNA, 2320 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434379 - DNA, 1662 bp, Homo sapiens
ggtacggtcgaaccgatatgcaccacgcgtcgtagttctagatcgcgagggccgcccttttttgtggtatgttcacggcagcgtgtgtggtgcattagaaatcgtctgatctgcatgctctgtgtaaaaaaaagaagctgagttcctcatattcgtcagtgattactatactccactgggaaacctaaagatgcatgatgatggtgtattctgggtcacttactacaaggataggcctatacctcattccagtaataaacaagggctagacataaggaggtctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434380 - DNA, 1556 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggtgagtatgtggctttaaacttttacaaattctcctttggccttgcagataatgcttttgtctagttctcattcattcaacacataccttttgagcccctacgttattccactctctgttctaggcactgggacatagcagtaaacaaaacagcaaaaatacttgttctggagcttatattatagtgagggagatgagacagacaagataaatttataaaatatgtaatacgtgagaaaatggtgagtgctaagaagataaataaagtaggaaagggagataacacatgccagtaagaggaaaatttgagatagatagcatggccagggcagtccttgatgcaccacgcacgtacctgggtgtggcatgtaccaggcagagggagcagccaggatgagggcctgcacctgggagcctgtctgagggtgtgaagaactgcagtgatgacaggggttg

SEQ ID NO: 434381 - DNA, 660 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagtgctactctgaaagtgggtccgagctgaatg

SEQ ID NO: 434382 - DNA, 650 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagaggggaaagtggggatccttaga

SEQ ID NO: 434383 - DNA, 353 bp, Homo sapiens
ttacattagcacatacaaaccatgtaagatggccttttgaccatattaaatgggttggtgtatattttaagcaagaattataatttatgaatataccatttaatattacacgtaggtgggattatcacagaatagcttaaaaaaatcccctaaacactaatcatgtgttatttttggcttcaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgc

SEQ ID NO: 434384 - DNA, 1285 bp, Homo sapiens
ggttgtattattatgttagattttaaaatactagagttcaaactgtactttttctactgttttttagacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434385 - DNA, 2262 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactga

SEQ ID NO: 434386 - DNA, 2669 bp, Homo sapiens
acgcgcgttgggggtcaggtgccggaagaggaaacctctcgctggggctaggagttcggcggggcgcgcgccggcggctgcggagctggcaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434387 - DNA, 2745 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434388 - DNA, 2649 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434389 - DNA, 2473 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434390 - DNA, 1956 bp, Homo sapiens
  misc_feature (43)..(43): n is a, c, g, or t
  misc_feature (48)..(48): n is a, c, g, or t
ccattggagctcggcccccatccttccttctctcacgtcctcnctctnttcgaatctgtaacgtaattccacttacagccagcatgccccatactgccaggataatgaagtcattagtttgaaaaggcacatttgtgaaagctctgtggaaatccttgttgagcgctctcttgagtacgttcaaagtgatgtaggaaaggcttgtggaccagtaacgtgtcaatggctaaaaccaccgaatagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434391 - DNA, 1535 bp, Homo sapiens
ctgccactgctttcaactcgacggttctcatctctgcgtatttctttactccactggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434392 - DNA, 1662 bp, Homo sapiens
gattcttcctctaattagattttattgttgaagttccttcatatggaagatattttccatagtatttggataagctgaactgtgttttaagaactcatatggatgttgaaggttgttttcagtttatctttccagggaacttctgttcagctctgagtgggtctggtcctttttcatgcctgagggagcagatgtgattgcctgtgattgaagccagtggagagttataaactatttttgttctaacatggatgatgcctaaactcttccactcttccacactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttacccttggtttttttttcagtattttttaaaatttttaagttgtgataaaatacacatgaaatttaccttcttattcatgtttaagtgtaca

SEQ ID NO: 434393 - DNA, 2443 bp, Homo sapiens
acgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggtaggcgatatgtaacagatgttttgtgtgttcgagtgactgtttgaatactgcctaattggatttgcatcctggagtggtgttgcatgtcagtgcttctcctgtggagttctggaaatctgcattgatggtgtgacactttcagacagcaccaggactagtaaaagtccctccttcctcaaaggcacagtagatgaaatatagaatgtctttagaggtagctttgtatctatttgttgtgataagtggtatgtgtttattagaaataatggaggtaaaggaaataaggaggtaaaggctctgatggcagctgagtcggggaacctggtactttgtttctggtcttctgttgtaccctcaacctccactcccatccgctgccaaaccccaggtgtccctcaggtacttaatcaccctggggcagtagcacagggctggttctggggtttttttggtgtttttaaaaagtaattcaattgctatcagtttttaaaatctggttaacttataagttaactttctttgccattgtttaataacttacatttcctgattattgtcaaaaacaaacaaaaacagcatctgtactcaaaagtattctatttggttgtttcctttctgtgacaatgttcttaaaatactagaataaagttgatgggactgttagacataaaaatagccatttcatgaggctgtcaactctatagagaatgcaggatataatagagtacaagtcatgtgtcccttgtctctctgaagactttttttttctaagactactggatagtctgatgaaaagcagtgttgtgtaggcttggcgaaatgacagattcacatggggatgtttttgaaatacagattcaaggctctaccctacatgtgctaaataaaatacttcctaatggctgagcatggtggctcatgcctataatcccagcactttgggagaccaagtgggaggattgcttgagctcaagtttgagaccagcctgggcaacatggtgattccccatctctactga

SEQ ID NO: 434394 - DNA, 247 bp, Homo sapiens
gggaagatttggaataggacatgcacactggatcagctcagtaatttatgttttggtcgacttcctattcatgacaatgtttcttctggactgcagactctcctttccaattcctcggaaacaggcactgccagtggactggttttcatccttagaccagagcagagtacatgcacttggtacttggggacttcaggcatacagcctgtccagaatatggctatcctactctcctactcagaaagag

SEQ ID NO: 434395 - DNA, 2963 bp, Homo sapiens
gggaaggccgctgttttttcctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggaggctcctgaacaggatgatctcagatcccccctcaaacaacagctggaactctgttctctatcttctagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaattagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgt

SEQ ID NO: 434396 - DNA, 3344 bp, Homo sapiens
gcacggggacctcaagccagaccccagcgttcagccgccacctcggcccgggcccgccccgccccggccccgcccctttcctgcccgccccaccccctctacgcccctccacccggaccccgccccctgggcagccccccgccctctccgcccgggctccgccccctccccctggccctcgccaccggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaattagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgt

SEQ ID NO: 434397 - DNA, 6976 bp, Homo sapiens
gacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagacagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctgaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggctttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcatttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacatgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgcagcgtg

SEQ ID NO: 434398 - DNA, 5120 bp, Homo sapiens
  misc_feature (165)..(165): n is a, c, g, or t
ttcctcgctgcttatgcccacagggtttttctgtatgacacacctcagaggagcctgtgattaacatttgtaggattatttcgagggcagggcaggggaaagaaacgcgttaaagggccatgacatgacacagttccctggccgggtttggactgaacagtggantcagaactgcagcgttcaaagcccctgcccgccttagattctcatggctacctcctctgacccatccacatccttgcggctggcaggcaggatgttttgaaatggtgcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctgaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggctttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcatttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacatgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgcagcgtg

SEQ ID NO: 434399 - DNA, 535 bp, Homo sapiens
acaaatcttgcccccagtccagagggtcctaatctgagaactccaaaatacagcctggagacaaatggtggggagggtttcccctaaatttggacatctccagattaagacctccgccgaatccgtgaggctttccctctccaaggagctcctaagagaatttcccagtaaaatcgcctcaactgcggtaaataggctgttccccgcgccagcatttgagaagagctggtccccagagtgtaaaggagttaggatgttggcaggaggaaggatgtgtcgccggatgaggaaaagaaagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 434400 - DNA, 932 bp, Homo sapiens
ggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 434401 - DNA, 289 bp, Homo sapiens
aattaataagggaaagctaatggccgggcagcacctatgatataattttagagaccaggattatgccatgtttagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 434402 - DNA, 280 bp, Homo sapiens
  misc_feature (29)..(29): n is a, c, g, or t
  misc_feature (32)..(32): n is a, c, g, or t
atagtacaggccacaacgacggaagaganccnccccttcccgactaatcggtgagtcgtcttagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 434403 - DNA, 957 bp, Homo sapiens
ggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtggagtcagtggttcttgttttaagccac

SEQ ID NO: 434404 - DNA, 424 bp, Homo sapiens
ccaaggagcgagtccaccgaggccatcgccaggtggagcggcggccccggcgaggtaccctcggccagcaggagggagaagcggagggcgcgtcccagaggcgggggccaagggtctgccactcacccgcgccttcggcgggctgcggcggcccgacgacgccgttcaggtagagaatgggcagcagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 434405 - DNA, 991 bp, Homo sapiens
cgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 434406 - DNA, 1195 bp, Homo sapiens
cgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaaaaaaaaaaataaaaaaacaaaaaaaaaaaaactctcggggggcctttattgcggggggggggaaaaagggggcatgcacagcgcgccccggggccaaacagcgggtttccgggccccagtttttctggcaccacgggggcgaaactggggggggccccaataggggggcccgataaacccagaaagcccgggttacccggtagc

SEQ ID NO: 434407 - DNA, 838 bp, Homo sapiens
cgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtgagaagtggcgcgggagcgagtagggggtcctgcgggctccgaagccatccggggccagggggtcccgaaggcgcgcagagccgcgcagagctcctgcctgtggcctctgcccctccgaggcacaagctccggggctgtgtggtgaggtcgaactggtggctccggagaacgagctggtgctgattcccgccctgcgcaggccggggcgccgaggtcgggacagggtcagtgcagcggtgccgccttctttccactgcctgcagcccagctggcccgatgcccctgcaggaaatgagctttctcttcttggagccagtgctctgccctcctcaggcttctggcctcctaa

SEQ ID NO: 434408 - DNA, 974 bp, Homo sapiens
aggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 434409 - DNA, 1111 bp, Homo sapiens
cgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttggtgagtgacttttggcccttggtccctcacctatgaattctcattcctacttctcaatatgatcttcattcttcgacctctgccatgatcctgactccctaaccccaagctcaatttcagtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 434410 - DNA, 1003 bp, Homo sapiens
aggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagccacctatgtccctccgctctctctatagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 434411 - DNA, 788 bp, Homo sapiens
aggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcaggtgggaagaacagggccagggtttggctgggaggagcccctggacccagctagaggtcttgctccctatgaat

SEQ ID NO: 434412 - DNA, 883 bp, Homo sapiens
cgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 434413 - DNA, 1157 bp, Homo sapiens
cgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaaaaaaaaaaaaaaaaaagagaaacaacagcggccacaaacaaacaaagaacacacaaaaaaggacaccgacaaaacgcgaaaaagaagaacaaaagagacgaaagaacaagacacggcagggcgacacaacgcagacacgcagagagcgaacggagagacgaacgagcagagaacaaaaacacaagagacgagcgac

SEQ ID NO: 434414 - DNA, 2649 bp, Homo sapiens
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434415 - DNA, 2677 bp, Homo sapiens
ggtcgccttgctggagaggcctctgcctgagctgagaggaggctggagctcactccccgggcttcatcttgtggctgcctcagcctccctgcccctaaaaccactacgaacccacttgagaggtgtcctcgggaggatgcccgcagaaaggcctgcccgggtccctgctggcataggcccttccagcaccttccactaactaagcctctgtttccctaagagcacaggcgtcctccagctctgtcacctgactgtcagaagtcatgtctgctgtttgtcttgggatggagctgccggggacacggcccctcccaccacaagtggccaagggcatgttgtggtcgggaagcttcaccggtcggccccggccacctcacctctgcctgccactcggggtcctgggccctgctgccccccgagtgcagctgcaacgccccttttgcctaaagcagcaggccctgccgacagggacctgagcatctttttcttccttccttggcctctgaggtcctgagagggaactccccaactctcccgccccagtcagcggtcacaggggagtctctgggcccacaacagggccggcctggtggctgagaccttggtggctcctggccacgctcaggaaggcccgtgtggtcagggctgcatttgaaccggccccgcactggggatctgccgagggctgggtgctgatgtccccaccgcgccccccgtcgatgtctcttgccaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434416 - DNA, 2339 bp, Homo sapiens
gatcttgctctgttgcccaggctggagggcagtggtggagtcatagctcatcaaaagctcaaccttccaggctcaagtgatgcttccgtctcagccttctgagtagctgggacaacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434417 - DNA, 2535 bp, Homo sapiens
gccgcttgcattgtttcgctctgtatgttgctgtgcttagtgctgccatgtgtgtgggccgtgtcgtcttctttcgctgcttgtggtgcctctgtgtatggtgcgctgctggcttcgtgttccggcttgggtgacgcctctgtctgtccgccttccccgtaaatgtctctaccatgtccgtggccacttctctctcggcggctattgccggtggtttaccccctcaccccgtaattgttgtatgtcccctcgggcttaatattcttgggggttgggggcccactgttgtcaccgccccccagtggggtcttcctcccaagggcccggcggcccgcgttttttcccgccgagcggttgttactcggcggccccgcgtcggtgtttatttcggccccctcttggggccccctcttttcccaaaaatgggttctcctttttgtggcccccccgggggttttttttttgcgccccccccccttttttttttgtttgttttgtttttttttttttttttttttttttttttttttgtgttgataaagctttatttataaacacactcacagggccagatttgggccacgggccatagttgccagcccggctttaactgctggtcctcacgttagtctcactgcctcctgcagggtgggcatgtgggtgtcgtgttcacgcagccccttcctccaccccacagacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434418 - DNA, 2561 bp, Homo sapiens
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434419 - DNA, 2656 bp, Homo sapiens
  misc_feature (2630)..(2630): n is a, c, g, or t
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagacacatagcacataaaaacccgatggatgtttttttagnaattagagagaaaacaagaaacccag

SEQ ID NO: 434420 - DNA, 2003 bp, Homo sapiens
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434421 - DNA, 828 bp, Homo sapiens
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggctggagtgcaatggcgcgatctcagctcactgcaaccttcgcctccagcgttcaagcgattctcctgcctcagcctccacagtagctgggattacaggcccccaccaccgcgcctggctaaa

SEQ ID NO: 434422 - DNA, 1797 bp, Homo sapiens
gccgcttgcattgtttcgctctgtatgttgctgtgcttagtgctgccatgtgtgtgggccgtgtcgtcttctttcgctgcttgtggtgcctctgtgtatggtgcgctgctggcttcgtgttccggcttgggtgacgcctctgtctgtccgccttccccgtaaatgtctctaccatgtccgtggccacttctctctcggcggctattgccggtggtttaccccctcaccccgtaattgttgtatgtcccctcgggcttaatattcttgggggttgggggcccactgttgtcaccgccccccagtggggtcttcctcccaagggcccggcggcccgcgttttttcccgccgagcggttgttactcggcggccccgcgtcggtgtttatttcggccccctcttggggccccctcttttcccaaaaatgggttctcctttttgtggcccccccgggggttttttttttgcgccccccccccttttttttttgtttgttttgtttttttttttttttttttttttttttttttttgtgttgataaagctttatttataaacacactcacagggccagatttgggccacgggccatagttgccagcccggctttaactgctggtcctcacgttagtctcactgcctcctgcagggtgggcatgtgggtgtcgtgttcacgcagccccttcctccaccccacagacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtaacagagctcgggctcaggggctggtttgggaggggagtggcacacaggtgggcatctgggtaccgaggatagtgcccccgagttcactgcggaaagcctggcagatgcctggcatatacagataggaagaaacctggcttgtgaggacgcgtccacagggccatctgttagccccggcccggctctgtccccaccgtgcacactgccagaccccgcctctcgtgtctgtccagctgttttggtggcatcttcccaggagggaagggagtccccgtctcgcgcccttgtgctacctgctggtgcaggtaccagtgtctgtgacgagctcaggagggctctgacatggccggggtggctgtcatgcgcccgagtgggccttggggtcccctgctgcagggcctgggttccagggtgacgtgaaggggcagcgctaacgatgcctcctgccctcgtggctgctcactgcctgacgccatccagctctggagcaaaacaggcctggaactttccagaaggggctgggacagagccctggggctggtgcacactcgccgtctggccttccccaggtccacgcggcccccgctcttgcttagctgaaggtcgccagatttagcaagagggtctctgtcgcccaggctgagtgcggtggtacaatcacagctcactgcagcctcgacctcctgggctcaagtgatcctcctgcttcagactccggagtagctgggatcacaggtgccaccaccacacaaggcttatatttgtatttttttgtggggacagggtcttgctatgtcacctgggctggtcatgaactgggctccagccatcctcccatctcggcctcacaaagtgctgggattatggacatgggccaccgagcctggctagatacatac

SEQ ID NO: 434423 - DNA, 1948 bp, Homo sapiens
catggggcgggggcctcctgggctattgtacaaataaacctgaggcaggaaaaaaaaaaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434424 - DNA, 2687 bp, Homo sapiens
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgcaaaaaaaaaaacaacaacaaacaaaaaaccaaaaacaaa

SEQ ID NO: 434425 - DNA, 1526 bp, Homo sapiens
gcatgggggtgggctcgccccagctcaccttaggctatccctgggtatccacgctgctgcctgtcatctgccacggcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggtccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434426 - DNA, 1503 bp, Homo sapiens
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagcctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 434427 - DNA, 1693 bp, Homo sapiens
ttagaacaattgctccccaataatttattttacaaacaggaatatgaaaaataaatggtggtaggaggaaggacccactaagaacaccatttttaaattttgctaagtaaggacattgagggaaaaaactcaaactctgatctaccatcattgtttaatgttcggcaaacatgaagcattttaataccaaaaaaagtgaggagaataaatctcagcataaaggaacaactttttaaactgaatttagcactatgaaaaatgtacctcattttctgtaattttagcgagtttcccgcggatgtacactggccccatggattggcgctggggatcaccagtttagaggtgccagtgccttctgacaaaggcccatggatccatatgactgcctgtctgttctttttagagacgggcccacactgcagagaagtgattgtgaaggtctccaaccctgtcatgcccccacctgccaccttgacttgggagagggacactcacaaaagcatgtcaaatcgacatccatttctttctctttccctcaggtctcagggagttttcctcttctcctcggactctttctctcaaggcctcttctacaaaaacccctgcccagagggttactgctaaaatgaaactcccgtgtctgtccccttccctggcccccaactgacttgcctgcctctgcttgctgctgtccctgcctattccccttcatgctggctctagaaagatgcaatctttttcccaggccccagcctctctggcctccctgccatccagcttctagcctcccttctctggaatctatggaagaatcatcaagcagcttctggaaatccaggagtctgtccttggtcatggtcatcttcaacctgtctgtgttcttgagaacgttcatgtgctcccagaaacattctttttgtctgcctttcctggtctggccacatttgactgtgtcacttctctcttttctcactcttctctgccctccacagacctccgtgctgccaggacttcctaacggaagggcttggctggctccccgaagccatccagaactggacccgagggacccagctcaacttgaatgtccttttatctgcccaggagatgggaagatgctgagaccatgcttcagtgctgtcccacatctgtctttctgagtttagacttggtttttccattatattccattcaactgatttttccatgatattccacaatgtcttacctaactctagctttctatactcaacagcaatgcctcctgagagcctcctgggtgtcaagtactctgttgtgtgcttttgaggactagggtgttagcaaggcacagtctctgactttgcagggctcacagattcatggggaaaattgatgttccagttacagtgaggcaaggcaatctggcagtaactccatagagaggaatgacaggctgggcctaggaatggaggggagcgggtaatagaggatcctaaggaaactgagagaagaggggctggagtgcggctggtctgcgctcctgtgcattgccttggctaacattttacttgtccttctgaatcaccctggcattgtcaacaaagaataatgtatgatccttcttggagtaaaaagccttcagcagtgcttcacaaaaaattctattgtatattttgtgtcctacctcaaattaattaaaaaaaaaaaa

SEQ ID NO: 434428 - DNA, 4107 bp, Homo sapiens
  misc_feature (2039)..(2040): n is a, c, g, or t
gcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgctgagtcccagaaccccacggtgaaagccctgctcattgtggcttactccttcatcattgtcttctcactctttggcaacgtcctggtctgtcatgtcatcttcaagaaccagcgaatgcactcggccaccagcctcttcatcgtcaacctggcagttgccgacataatgatcacgctgctcaacacccccttcactttggttcgctttgtgaacagcacatggatatttgggaagggcatgtgccatgtcagccgctttgcccagtactgctcactgcacgtctcagcactgacactgacagccattgcggtggatcgccaccaggtcatcatgcaccccttgaaaccccggatctcaatcacaaagggtgtcatctacatcgctgtcatctggaccatggctacgttcttttcactcccacatgctatctgccagaaattatttaccttcaaatacagtgaggacattgtgcgctccctctgcctgccagacttccctgagccagctgacctcttctggaagtacctggacttggccaccttcatcctgctctacatcctgcccctcctcatcatctctgtggcctacgctcgtgtggccaagaaactgtggctgtgtaatatgattggcgatgtgaccacagagcagtactttgccctgcggcgcaaaaagaagaagaccatcaagatgttgatgctggtggtagtcctctttgccctctgctggttccccctcaactgctacgtcctcctcctgtccagcaaggtcatccgcaccaacaatgccctctactttgccttccactggtttgccatgagcagcacctgctataaccccttcatatactgctggctgaacgagaacttcaggattgagctaaaggcattactgagcatgtgtcaaagacctcccaagcctcaggaggacaggcaaccctccccagttccttccttcagggtggcctggacagagaagaatgatggccagagggctccccttgccaataacctcctgcccacctcccaactccagtctgggaagacagacctgtcatctgtggaacccattgtgacgatgagttagaagaggttgggaagagggagtgggaggggtctgtctccacctgaggcagggaaagagagcctattctcacacatgatcttcagagtgctggaaacacactcctgcagaagctgtaggactcttgaattcctaggaaactgtccagcctcctagccccatgtgatgtgaaaactaaaaggcaccaccaactagacatgtgttcataaattcccatctaagaaacactgggaggcacagcagcctgtatctctgaggaagaggagcgaggacaacgttggcccagatgggggctgaatcattcaactgcctccatctgtggggcagctgctgccttacagcccttcctactagactgagcatcccgaagggagacctaaatcatactttgggtgtggtgacccagatgcacagagctctgcttgaaacaggtacacgggccagggaaatgccagcaagccagagcgggcgtggagatttttatgcctcactttctggagtcactgggccatgatgaatcataagtcttcagtggcctagcaatatccagataagaaaggaccaacttgggttccttaaaacaaagggaaattattattgccacttagaaaaattcagaaaagcacacactcacatacacacacacaaaatcactctcttatcccatccatttgtgataacatctgtgaacatgctgtggctctatttgcaacattttccttcgtgtgtgtgattgtgtgcatgtgtgcatgacctttttttttnntttttttttttttttttgagatggaatctcgctctgtcacccaggttggagttcagtggcacaatctcggctcactgcaagctctgcctcccaggttcatgccgttctcctgcctcagcctccctagtagctgggactacaggtgcccgccaccatgcccggctaatcttttgcatttttagtagagacggggtttcaccgtgttagccaggatggtctcgatctcctgacctcgtgatccacctgcctaggcctcccaaagtgttgggattacaggcgtgagccaccccgcccggcccttttttttcatttatactttttcatttagattgtaatgattaacagaaacaggggtacctttcccaggggtgtccaccagaagagttgaagaagaggtgagaagatcccaaggtgaagcctgtcaccacgcagacagaactgccccctattgtagacagtggtgggaagggcctggctcacatgcccctccttagaggcagcctcaagatgaaccagggaatcaaactcaaccaggaggcatgattccttctctcctgcaattgcacaaaaacaagtggtggtgaaacattgttctgttttcacaagagatgagggagcaggctttccaatatgctggaagtaattgtgcttagacacctcatcctcccaagctgtctagaaaggccatttcgctgtgttgtctaaataatgagggttttttcacaccatttctcaaaaggagatttgctgtcaacatcattttggtggttcaggtgtcactttcacttacagaaacttatgcatccttaagagatctcaattcttaagggtctaacttgccagagaaatctcattccagggactgattgtttttatcaccttctgtctggtcctgagtgactcactgtgtcacccagaaaagagacctgtcaggcagaatcgagcttaattcacctgctctaaacaattgttactgacacactgcttttaggttttcttctagcaccagataaactctgaaatcaaagcatggatatgagctcagtaggaaactaaggtttgagggagaaagagtttgtcacttagacctcttggctgttaactgaaactgaacttgctcacatcatctgcttccctgtaatgaactatgagggttctttatcctagtttctatttatgaagatggttgaaaattttcaagacacaagattttgaaaactcactgaattatgggcaaaaccatgactttcattgggcagacagagtcttctaagcccacagggatccccagatggatttttcaggacaaatggctcatgtgcctgtacttattgtctctgtggtgtgtcaagaagtagctaatggtttcatctgaaagctgccatagaaattctgtgaaccagaatgagacaaggcagcaggcatacagaaggtttgtcctgctctgggaagcatggaggatgttgtacttcactcctctctgagggtgtctaggaatacagaagctccttgacttacatctcaataaacccatcgtaagtccaaaatattggaagttgaaaatgcattgaatacacccaacctactgaacatcgtagcttagccaagcctaccttaaatgctctgagaacacttatattagcctacagctgggaaaaatcatttaacacaaagcctatcttctaatgaagtatggaatatctcatgtaatttattgaatactgtactgaaggtgaaaaccagaatggttgtatggatatgcgaagtatggtttctactgaatgtgtattgctttcccatcatcataaaatttttaaaaatcctaagttgaatcattgttagtccgggaccttcagtactgccaagtcccagagaaaacgcttttactctggggagaacccactgatggctcattagatctgtcccttccccgaggtccgtgtgtgactttgagcaaaaagtgacttctttttgtgaatgtaaaatttgtgaaacttgagtttttccaatgtgctgtaaagtgttttattgtaaattgctcatctcaataaaatttacttcaggttt

SEQ ID NO: 434429 - DNA, 2065 bp, Homo sapiens
caaatgcaggaattttctatagagtctgttatagctagccttctacaggcttaactcttctcatgatggagtattgaccatcaccaacaggaaatcttttgttttaggcactccaggaaattatcagggagttctctctgtagataaccaaagtttccctagttgtacttctacccatttttcttagtgtgatcatttaaagcagtgcctcaccaactatcagagatgggggccagtaatttttgtttcatttttttccagttcattacaaatcaatgcatatgtctgtaaaacacaaaatcacacccttaaatgtgatggcaacatcaaattgccataaaagtttctaaacttttcaccccaatttctgaatttatcacagactggtaaaaaacagctcacaagccagcaccacgggcagaccacactttgcacagtgctcaaacgtaggcctaacaacctggcttggcttggcacttctaaaaaccgatcctgaggcaaggcttcttgtaaaagagtttatactggaagttaaaaatcatcaaattattagatactgggaatggagtagtaaagtagacagagcagggaaggaataaagtatgaattttcaagctggttacccatctgggcaactggagctcagttttgctgggaaagtctggaagacagtgtcagatataactaagagttattcccatcaaggggaaaggaaactgtgcttttcatccaccaaatccttgcttaacattggaatacagatgcttccaagacattaactttgtggcacttctggcttttcctacacacttattgtgtatgccaccatgtctagggggaaaaaggcccacaggcaaagaggtaccagcattcataccaccagctttcagcttgtagaggtggccgccaagaggaactcgtagttggcagtgccaactacaactactacaccaaccagctggaaactatacaaagagtatgaacaaagttcacaggagaaacaaggctctgcaacatatgaaaatatattctacttcattcataatgagacgcatgaaaattgtaactgtatcaataccatttctcacctagtagatgggcaaaaatccaaatgtttgagcacacattctgtgggtgaggctgtggaaacgtaggttcacatacattgctcttggatatgcagattaggaccgctcctgtggagagcagttagggaatatctttcaaaattaaaaaatgcagagttaagttttgatccaggagtctcactcctgagaatttatgctatagatatgcctacaagcatttgagatgaaaaagaagcattgctatttgtttttcttgtttttcatgaataacattgtaaaagtagaatatgggcagtgattcaagcattcatctttgggactggttaaggaaactatgatgctttcacagaatgaaattctatgcagctgtttaaaacaaaccaagacaccttctttcacatatatggaaagatgtccaaaatatactgttaagtttttaaaaaggtacaaaataacatatatagtatgattccttttgcatatgtgtatttgcttttaattgcctaaagaaactctcagaaggattcaaaagatccataccaaacaagatgggagaacagaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatcgtgtgtcaattaaaaatttttaattaaaaaattataaacaaaa

SEQ ID NO: 434430 - DNA, 717 bp, Homo sapiens
  misc_feature (44)..(45): n is a, c, g, or t
  misc_feature (130)..(130): n is a, c, g, or t
agataggcctgcaataagactgcaggcccaagatatttgtctcnngttccaccagtaacttggggcaacttggtgtacaacaaggcacagagaatgcactcgtagaggccgtccagtttctcacgctctnctatggactgcagatactgctgcttgccttcctgagattcatctttttaaaaaggtacaaaataacatatatagtatgattccttttgcatatgtgtatttgcttttaattgcctaaagaaactctcagaaggattcaaaagatccataccaaacaagatgggagaacagaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatcgtgtgtcaattaaaaatttttaattaaaaaattataaacaaaa

SEQ ID NO: 434431 - DNA, 927 bp, Homo sapiens
gccgtgagccgaggccgcgccctcccttgcccccccgcctgggggaccagagcgagaacttatttccaaaaaaaaaaaaaaaggtaccaatttggactctgcctcccaaagtgatgggattacaggcctaagacacgatgcccagcctcattttcatttattcttgtaactggcatttaccacctgacccattaggttttgccttagtagttgagatctgatctgaattgaaatgttaattcatattctgaattattaaaagaacggctctatacaaattttactctcatagtaggatcttttataccaatatcacatccatattttaacgcatgaccatacaacacctctttacagttactaacatgtggttagtgtctcattgagtaatataggctgataatggcacgttgcaaagtgttgaccatatcattttatttattataattttggaagattcttttggatacagaatggacagagtaacaaaattgctgcattatttaagattgtctgttacttgaacatgccactgttttagacaggctccttccttttattttgaatcacttgagttcctgttctgtttgttgctttttcatgatgatgaaagattagtgagtttttccccagtagcattcccaagccaacttgcccaagaatcagagacaaagtcacaagaagggccaactctctcctgctgagaaggaataaaatttttaacactcttgtaagtatgtgaaaaacttcttactcagctgtggaagttgagctaagaataacaaaggaaaaaaagattatgaagcctgctgtcatgtctgagatttgactgattaatccagtgcgttaaaaatataacacgactttaccgaatagtaaagggcgactgctttcttcagaacctccttgcagcagactaaaggatgt

SEQ ID NO: 434432 - DNA, 1535 bp, Homo sapiens
  misc_feature (2)..(2): n is a, c, g, or t
  misc_feature (23)..(23): n is a, c, g, or t
anttttggggggaatttggcccnttggagggccaaggaatttggggcacggggcctttttaatcacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaa

SEQ ID NO: 434433 - DNA, 4062 bp, Homo sapiens
ctggctggctctggggaccccccggctgttgccacagagaggaaagacctgtggcctcagattcagacagcctgagcttgtccccacaacttattgctgggagatctcgggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactacaaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaa

SEQ ID NO: 434434 - DNA, 971 bp, Homo sapiens
  misc_feature (8)..(8): n is a, c, g, or t
cacggacnacgagtcctgctcaggaagtctctggatcctaggctcatctccacaggggtagaacacacagacagcagagacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaa

SEQ ID NO: 434435 - DNA, 3929 bp, Homo sapiens
  misc_feature (3872)..(3872): n is a, c, g, or t
agcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactacaaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgactcggtcaggcatcgtcaagcctgcccaggccctccaggcctntttgatagctactgagcccctgaaggcatcaagacgtgaccacgcatggcagtgccc

SEQ ID NO: 434436 - DNA, 3428 bp, Homo sapiens
  misc_feature (3373)..(3374): n is a, c, g, or t
  misc_feature (3382)..(3382): n is a, c, g, or t
  misc_feature (3396)..(3396): n is a, c, g, or t
  misc_feature (3399)..(3399): n is a, c, g, or t
  misc_feature (3401)..(3401): n is a, c, g, or t
agcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactacaaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcaaggatgtttatggcatgttctctgtcgtgtgtgtgtgtgtgnncctctatntgtgtgcgtgtgtnttncnggcttaccgctctccaattctttatca

SEQ ID NO: 434437 - DNA, 2670 bp, Homo sapiens
agcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactacaaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctctgacccaaatgttctgaattgcagtactctgggagatgtgggtgggctcactgag

SEQ ID NO: 434438 - DNA, 302 bp, Homo sapiens
ggggattctcgcttgctccaagcagagctggaggtgacagcgggtttctctgcttaccagttggggtggactattccttctcattctccatggatgccccttgctagggcaggctcgtagcctagggcggcagaggtcgggcagcaggacgtcctccattcacatccccaccacaggctggggctgaggaaaacgtctggactggaaagttctgctctcctttcttaagcgtctgcgtgccatgtcggagaggaatcccaggacaccgcgaggtggtcctgctgcctgttcagcttttgcca

SEQ ID NO: 434439 - DNA, 609 bp, Homo sapiens
agcagcgccgagaattcaccggagctcggggaggcgaggcgggagccctgagctgaggccgggcagcgcggacccgcgcaggaggaggcggcggggacaccggcgagtccccagcagggcccctgggctcccggaaggtgggttcgcgccggcggcggggactttcccagggactgggaggtgtggccgcggcgggcggcgcagtctgggcaggggctgaggcgtcgcaggtccccagcgcgagcactggcccggagcagcccgatcccaaagcgccctggaggggacgcgctcctaccgcccccccgggagaggccgctcatgcgctcccgcgggttcgctgccctcccagaggagccgggcagccagggctggacttcatctcctagctccctgctggccgtgtccgggctcggattctgggtggaggttcggggtctgccgtctgagagggagggccgcactcagcctctccgggtccactcccaggcggctggtgacctccaagcccagcctggctcctgtgtataggttcagtgagatggaagtttctgtccccacggatgcggtccctaactaatgggaggtggcccagggcacctggaccca

SEQ ID NO: 434440 - DNA, 4087 bp, Homo sapiens
agcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactacaaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaa

SEQ ID NO: 434441 - DNA, 4457 bp, Homo sapiens
agcgccgagaattcaccggagctcggggaggcgaggcgggagccctgagctgaggccgggcagcgcggacccgcgcaggaggaggcggcggggacaccggcgagtccccagcagggcccctgggctcccggaagatgaagaaaatgagacttagcaagcctgacaagacgtagagctaggccatctgatcccaactctagtgtctgcatctggagacagtggttctccaccccggctgcacactcggatcatcgggggagctgaacactgctgtctaagtcccatctctcgaccaattgaatcagaatccagttcctcagggggattctcgcttgctccaagcagagctggaggtgctgccatgcgggcacttaggtgaacacgagaagcctcgttctagaacaatgagtcacagcctgcttgtttagccatccagcccaggtgccaccgccttcttccctccacagctgcaggtttatttgcttctgtctctgaagaggtgagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactacaaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaa

SEQ ID NO: 434442 - DNA, 3622 bp, Homo sapiens
agcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggaccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatcccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacacacaccccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaa

SEQ ID NO: 434443 - DNA, 625 bp, Homo sapiens
gttgttttgtagtgtgaatgagcatgagtcactgatctaagccctttcactggatgaagtgaaaagattttttttcaacaaaagagggagagagagaatcaagactctgataaacatagtactatttttaaaagaaatccaataacaataaagattgttctattctctgccttcccatttagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcaggtgagtaatcatctctgtctttggaataaattaacaagtgttttttgagaaaggaattgaaaagtcaaattgagaactggagataaaaactcatctgattgacctcatcctacccaatcctctaccttttcttccaagcaaaccgccatcagaagtgagtagggtggagattctgctgaagcacatactagtgaggctttctaatgaaatgttcattaaaactatttattattatttgatagtataattattaactgatgtgtataattatagaatgattgttaattaaactc

SEQ ID NO: 434444 - DNA, 711 bp, Homo sapiens
  misc_feature (3)..(3): n is a, c, g, or t
  misc_feature (272)..(272): n is a, c, g, or t
  misc_feature (274)..(274): n is a, c, g, or t
  misc_feature (288)..(288): n is a, c, g, or t
  misc_feature (292)..(293): n is a, c, g, or t
  misc_feature (310)..(310): n is a, c, g, or t
  misc_feature (319)..(320): n is a, c, g, or t
  misc_feature (322)..(325): n is a, c, g, or t
  misc_feature (328)..(328): n is a, c, g, or t
  misc_feature (331)..(331): n is a, c, g, or t
  misc_feature (337)..(337): n is a, c, g, or t
  misc_feature (350)..(350): n is a, c, g, or t
atncaccaggtggcctgcggtcatatactcctggatccttcgggctgcttgaattcggcacgttctcatctttcatttttgccgtggataggcgcttttattaattgttgtcctaatgaaatttctgacattgtcatatacaacgatgaatatcattaaaatttttaaaataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaananaaaaaaataataanaaannaacaataaaaaataaanaaaaaaaannannnnatnaanaaaaanaatactaaaaaantaaaaaaaaaaaaaaccttttaataaatatttttttaatccataatttccacccaaattaattgtctatctaacttacccctcatctttttacataataaaacatttgaattgtttaaacaacatactaattgctggattttttaaaaaactcggatttttggaaaacatcaaaaagtggtggatgaaaataaaagctctcaccccattgggggtggcccctcttacccaaaatagtgttttattggtggcctgagcataatccaaatattattctccttctctgttcacaagtgtggatttgtttcaaaaagggcctatttttttacctaatagggtatttcattctctcccccctcctt

SEQ ID NO: 434445 - DNA, 1999 bp, Homo sapiens
  misc_feature (1959)..(1959): n is a, c, g, or t
ggcccgctccaacatcagaatggtaacagctttcaggagcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434446 - DNA, 2095 bp, Homo sapiens
  misc_feature (1665)..(1665): n is a, c, g, or t
  misc_feature (1667)..(1667): n is a, c, g, or t
  misc_feature (1681)..(1681): n is a, c, g, or t
  misc_feature (1685)..(1686): n is a, c, g, or t
  misc_feature (1703)..(1703): n is a, c, g, or t
  misc_feature (1862)..(1862): n is a, c, g, or t
ggcccgctccaacatcagaatggtaacagctttcaggagcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaananaaaaaaataataanaaannaacaataaaaaataaanaaaaaaaaccaaactcaaaaaaaaaaaattataacacaaaaattttctcacaattctcctttcctccaaatttacaccaaaaatttttataaaaattccaactcccccctcttctttttcccacaaaaaccacctctctattcccttttttaaaaatanatccctctccccatctcttaatcttccccacttataatctcttttcttaaacccttattttcttcaacaaatttccccccctataaaacaaaaaatcccctctcttaactaaaaccgggttctttccctccaacatactctcttctatgccatccaaccactcgggcggtgattttttcagaaatatcccttcctggggctgctccctatttctacccactttctgctctgcc

SEQ ID NO: 434447 - DNA, 2104 bp, Homo sapiens
  misc_feature (1669)..(1670): n is a, c, g, or t
  misc_feature (1672)..(1675): n is a, c, g, or t
  misc_feature (1678)..(1678): n is a, c, g, or t
  misc_feature (1681)..(1681): n is a, c, g, or t
  misc_feature (1687)..(1687): n is a, c, g, or t
  misc_feature (1700)..(1700): n is a, c, g, or t
ggcccgctccaacatcagaatggtaacagctttcaggagcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaaaaaaaaaaaaaaaaaaaaaaaaaaaaaaaaaaaaaaaaaaaaaaaaaaaaaaaattaaaaaaaaaaaaaaaaaaaaaaaaaaaaaaaaatataaaaaannannnnatnaanaaaaanaatactaaaaaantaaaaaaaaaaaaatataaacctcgaaattttttttcctccttcccaatttccccccaaaaaaaagtgtttatttctccaatccccattttaaggggggggtaaaaaacttttgttttttgggggtgtcgaaaaaataatgcgtccccctgggggggtcccctaaccaaaatatttttttgggaatttttttaaatcccaaaattctttcctcctctaaaaaaataattccctggcccattttaaaaagggggtttattttcttataaacaagctctcttattgggatttttcctcaaaagggggttttttttcctaaaaaattcttttttcgggttcccccctctatatataaacccttgttggtgggaacataccccttttttctcatatcccttgcttctc

SEQ ID NO: 434448 - DNA, 2138 bp, Homo sapiens
  misc_feature (2098)..(2098): n is a, c, g, or t
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434449 - DNA, 1997 bp, Homo sapiens
  misc_feature (1957)..(1957): n is a, c, g, or t
atttctgcctgacattgtgtagctgtatcaggctggctttctggaatagctcagtggccaaagattgatcacgaagggtttagagctgtgaaaatgccccagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434450 - DNA, 2062 bp, Homo sapiens
  misc_feature (2022)..(2022): n is a, c, g, or t
ggcccgctccaacatcagaatggtaacagctttcaggagcctaccagccggcagctccggagctgcccgcgccatgtccgcgcacaatcggggcaccgagctcgctcgctggttggaaaacccaacaacccaaaaaacaaaacccaaaacaaacaacccccaagcagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434451 - DNA, 1851 bp, Homo sapiens
  misc_feature (1811)..(1811): n is a, c, g, or t
ggcccgctccaacatcagaatggtaacagctttcaggagcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434452 - DNA, 2084 bp, Homo sapiens
  misc_feature (2044)..(2044): n is a, c, g, or t
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgttggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434453 - DNA, 2009 bp, Homo sapiens
  misc_feature (1969)..(1969): n is a, c, g, or t
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434454 - DNA, 1405 bp, Homo sapiens
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcaggtgagtaatcatctctgtctttggaataaattaacaagtgttttttgagaaaggaattgaaaagtcaaattgagaactggagataaaaactcatctgattgacctcatcctacccaatcctctaccttttcttccaagcaaaccgccatcagaagtgagtagggtggagattctgctgaagcacatactagtgaggctttctaatgaaatgttcattaaaactatttattattatttgatagtataattattaactgatgtgtataattatagaatgattgttaattaaactc

SEQ ID NO: 434455 - DNA, 1993 bp, Homo sapiens
  misc_feature (1953)..(1953): n is a, c, g, or t
ctgaattaatacttgtaaagcatctagattcataatgcatggcactcaatgaatcttaactactgtgatcatttctttgtctccttgtgttattttgttaaactacattaataggtttaagatacatttgaaggaaggaagttgtttaagatatttgcaaggtatgaaatagcgtggtctctttcatggaaatgctaatctggttggaagacagttctttcattaatgaacaatgcaatagaaatcagctaatggtgattcttcttgagctgtcacaactgtatactgtgtacttttcattaagcatgagcaaattaggagaaaatgagtaggcactcctgttttgtagtaaaatgttacgatgtataatattaagcatagggcataaaattgtttttattcatctcagttatgtattaaatgaaccaacttgattttaattggcattgtggaaatatggaggcaagagtatcagaggtcagtgagaatatatttggtgcctaatacagtgatggtaagggggaaaaagtatggacataatcattttaacagggagatttcggttttagtttttccaataattaatgaaaaataacattgggtttcttcgggaaacaaatttacacaactcatttctcccactgactcaaaagtgtaaaaaaagaatctttaattaacatggagtttttcctctttgtgtttaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434456 - DNA, 1454 bp, Homo sapiens
  misc_feature (1414)..(1414): n is a, c, g, or t
caaccacttttctacttttatcaccatgcttagctttgccagtattagaacattatctaatcacatagtgtgaactcttgggtgctttgtttttggtttgttttgccctcactaaaaataagagataagagatcttaaggagtttgcctagaagtatttcactgtgatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagagggggggcgccccccaagagagtttcccccgcggggggccgcccaaggctctttaagcgcgtcgttactcccggcgttttctctggctgttcacagagggggtggcctcccccatattagggtgagcgcgctcgcattaatatatatagggcgctagcgagcaccgcgtggccgcgcctcgctttccacccacacgcgttccgttggtacgctgggcgacaaacaacctgcgtgccgtaccgcggcgggggcacctcttttggggcgacagcgggaacccccctttaatcttctcggggggggggggngcacccatctacttggagacacgaacaccttacccttcgg

SEQ ID NO: 434457 - DNA, 875 bp, Homo sapiens
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggtaagtgttttatgttcaaataatgt

SEQ ID NO: 434458 - DNA, 1119 bp, Homo sapiens
tgggagcaagagcgaggtggcagtacagcaggctggcttgctgtacgctttataattccagcgaggaaatctttcgaatacacacttgcattctgtcacagtaatgtggagaacacatctagggttttcagcttgttttattcagctgcctggagtagttaaaatttttctgagcatattgcttcccccaaccccatgaggcgggaaagagatgtttagagacatatttctcttttaggaagaaatgcagaaccactgagacctggacaactgttggtcttattttctgcttggatgagataccttcctgctatttcttaaggaaatatagttatccatcctcacagtcacagctgaataccaggcagttggttgagtagtgagttcttctggaagatggacgggaaaactgtcaacaggattgatcattaaaaaaaaatccagtgaaatgtttatttaaaaaattaattgaactcccttgcttttagagacttgactattgtccagatcagatcttgtttcgagtgtgcacattcatatataacagggctgtgaatcagactgggaaagcctgtgctgcagacattcttccctccccatgacagcaaacacaggacagggggttcttagcacgttgtcagataaattcttttctatctgcgtgttttaattatggaattttaatgttgattttcattctgttttccaatcccatatattttttccttctcattggcttattgtgtgggttatcatttcagtgacctggtttgacaagaggcaacacaaatttctttgagaattcaaatgtccatttaaaaattagcatcaggggctgggcacagtggctcacacctgtaatcctggcactttgggaggctgaggcagcgggtggattgcttgagttcaggagttcgagaccagcctgggcaacatggcaaaaccccgtcactataaataatataaaaattagctgggcatggtggcacacacctctagtcccagctgcttaggaggctgaggccagagggatcagttgaacctgggatgctgaggctgcagtgagccacgatcacgccactgcgctctggcctgggtgacaaaggaagtccctgtctc

SEQ ID NO: 434459 - DNA, 1226 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaa

SEQ ID NO: 434460 - DNA, 1116 bp, Homo sapiens
ccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttatagacttctgtcaccatattttgaagagcaagggtttagttgattttaaggcaggtgtgtacccccctgggacagtgcttgtagaaaaacagaactattacccatgggattttcatggattatactgcttagctttcttgggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacgggaaataaaagagaatgaaattgtggcaacttttttccctcctagtttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaa

SEQ ID NO: 434461 - DNA, 471 bp, Homo sapiens
cagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaa

SEQ ID NO: 434462 - DNA, 896 bp, Homo sapiens
ccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttatagacttctgtcaccatattttgaagagcaagggtttagttgattttaaggcaggtgtgtacccccctgggacagtgcttgtagaaaaacagaactattacccatgggattttcatggattatactgcttagctttcttgggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattagggaaataaaagagaatgaaattgtggcaacttttttccctcctagtttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaatta

SEQ ID NO: 434463 - DNA, 424 bp, Homo sapiens
gacatttacctaatacttgtctttattgcagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataaggtaggtggaatttttttccccaatatttggtggctttgtaaagttttttaaaaactacttgctggaaagg

SEQ ID NO: 434464 - DNA, 450 bp, Homo sapiens
  misc_feature (120)..(120): n is a, c, g, or t
  misc_feature (206)..(206): n is a, c, g, or t
  misc_feature (218)..(218): n is a, c, g, or t
caaagtgtgtgtattgaaccatcagaaagcaaaagtgttactatcttagccacccatctggataatctgtggtttggcatcagtgttactcctgacgcccccccccctttttttttttgnttttttttttttttagaaaaattttcttttcccccctttggggaaaaaaagggggtttcccccccccttgggttttttaaaatttntcccttggaacntacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434465 - DNA, 482 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagtgagacagtatttatgtcttaaaatggcatccaactccatgcagagaactgaggatgtgctgtgcctttgaacttcagttaagtgtgctttggacgtctgaggctgtgggcttattagaatctcagtttttacctatactgagagggcttgccagacaaagtagatgagggtttgaggtacaaaacgggtttctctttttgtagttaggggtaatactttcaaggtcaatgatgtgt

SEQ ID NO: 434466 - DNA, 577 bp, Homo sapiens
gggagaaactaaagcactgtttgtattgtcagccatagattaactaatcctgtgcttctcagataattgtttttttctgataatagttgtgtctgaagatggcttctaacattgagcagcacagattttaaactcactactgatcagtgctgttaaggtcaggagaggtaaaaatagcagcatggctaatgagttacctttgtgtttaatctctttataacttgttaccagttcaaatgacagatttaagaaattgtgtattattttaggaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggtaaatactaatcaaaattgcaacgatcttgatagtatgttctcttacttcagagttggaaattgaaactgtatcaggatttggtcaaaaagttttgttacaagtgaagc

SEQ ID NO: 434467 - DNA, 1508 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434468 - DNA, 1674 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434469 - DNA, 1392 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaa

SEQ ID NO: 434470 - DNA, 1606 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434471 - DNA, 2305 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434472 - DNA, 1375 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaatgaaacagaaaacaaacattaaataaactacgcgcaccaggggggggcccgggtacccaaattgcccttaaaggggtcgctttacaattcacttggccaaatgtttacaacttttcggactggggggggccctgggtgcccacatgcgt

SEQ ID NO: 434473 - DNA, 1404 bp, Homo sapiens
  misc_feature (1375)..(1375): n is a, c, g, or t
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaactttacaacaacagccacccaagccgattcctaagcagcaaggacctggtngggatccgctccagcaggatggcactccc

SEQ ID NO: 434474 - DNA, 2500 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggtcccactaagcagctggtctaactggagttaatggtctgctggaacttccagcatgcactgtggtagttatatcagcatatacaggagcactggaacagagggggccagtctaaaagataagggatgaacacagtgcaggccagagagaccagctgcttcatgggatgtgaaaaatctacttttataaagtagggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434475 - DNA, 1310 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434476 - DNA, 1181 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaa

SEQ ID NO: 434477 - DNA, 2394 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggtcccactaagcagctggtctaactggagttaatggtctgctggaacttccagcatgcactgtggtagttatatcagcatatacaggagcactggaacagagggggccagtctaaaagataagggatgaacacagtgcaggccagagagaccagctgcttcatgggatgtgaaaaatctacttttataaagtagggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434478 - DNA, 1599 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataagggatgaacacagtgcaggccagagagaccagctgcttcatgggatgtgaaaaatctacttttataaagtagggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434479 - DNA, 1358 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaaggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434480 - DNA, 1395 bp, Homo sapiens
ccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttatagacttctgtcaccatattttgaagagcaagggtttagttgattttaaggcaggtgtgtacccccctgggacagtgcttgtagaaaaacagaactattacccatgggattttcatggattatactgcttagctttcttgggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattattaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434481 - DNA, 753 bp, Homo sapiens
cagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaaaaaaaa

SEQ ID NO: 434482 - DNA, 940 bp, Homo sapiens
gggcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagggcatcttacataagaattgcttaattgctatcattactttgctttatatactatatacctttctctgtcggtggattcgtctgacctaagcaaacataagtgggtttataagcaccaaaacacttttgttttccattaatttttcactaaccatacagataaaaaaaaa

SEQ ID NO: 434483 - DNA, 1932 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggtcccactaagcagctggtctaactggagttaatggtctgctggaacttccagcatgcactgtggtagttatatcagcatatacaggagcactggaacagagggggccagtctaaaagataagggatgaacacagtgcaggccagagagaccagctgcttcatgggatgtgaaaaatctacttttataaagtagggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagggcatcttacataagaattgcttaattgctatcattactttgctttatatactatatacctttctctgtcggtggattcgtctgacctaagcaaacataagtgggtttataagcaccaaaacacttttgttttccattaatttttcactaaccatacagataaaaaaaaa

SEQ ID NO: 434484 - DNA, 1686 bp, Homo sapiens
gggcatctgcgcaggcgcccggctcctaagtctacccaggaactgaccctgctctctcctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacgggggttgagacaggcagagaatgggggacttaaaactatttggaagggatgtgcttgggaaaaaagttactggctcggctgggcttaaaagtcaggg

SEQ ID NO: 434485 - DNA, 490 bp, Homo sapiens
taagtgtgagtttagcgctgctgtccggatgggttggtagcagacagggtggagtagggttaagcacactggtcaccttaggattggtttcctggtgctggagaatggttaggacacaggccttggaaggttttttgagtgtgaaatattactcagcgttttctgcagacctcgcgggcaatgccgcttctaattttatccaggccttcttctgtagggagggcctgttaagagttgagcagcccgatttctgaacccctctaaaaagctgtggctgattggtggcttttttttttcttggagagggggtgtcaaagatttctttaaaatcgttagtgatgtggtctcgctttaagatttttaatgggatcagaagaaaattcggtacttaatcacttccggtaatcttcatgacctgttatagtgactgcagtgtactctcaatgaggaagatatagatacgaaaagaactagagccgcatcacatggg

SEQ ID NO: 434486 - DNA, 1205 bp, Homo sapiens
aggagggaggctagttccctggtggggtagcctggcaacattcccattccaccgcacctggccagctgccatcttggcagagccagggggagatgcaccagggagtttggagtcaggaaggcagagttgtgtgggctgaagtctgcgggaaccccagggtgacacaggcaaggggtagaagtcagagtggggaccaaaccatagactggggccctgggttctgcagaggtgtggatggggcaggtggcaggtgctccagtgggggccccaggtgaggccctgatggccctcctggggcaataaagacatcatgggaagggggctttgtggtttgcctctgctctcgtcgggcgatctggctttagccttcaggaggaggtaagcagaggagatcagtgcctgtttctgaccccaggagggccttgttgggctccaacctagagccttccggcttcaggtcccaagagaagtccccccctaactgtgacccccctaactgtgatcaggggtctgccattgcccgcttttctctgcctgatctggggactcaggagaggccacggcagccacagcctaggggtggttcagtccctggcccacagtctggtcagttgagtccttctgggaaccggggctatgaaaactttcgtctttggggaccggtacccatgaaggaaaactttcctgagggggtgaggaccaaagaatcaagatccttttcaggcctgatagccaagatgatgagaacttttagataaggctgtggggagagtccctggccttttgagcatcctgcttgggcacacggggaataacctttctccagcttccagtgtgaactgagaaagagaaagggaaaccctgtctttggagaagctgggatcttcccagcaccagaaacttctgcaggcccctgcctggcccacggctaacctttgggtgggactggagtttcctgaacagggaacaagggagccttccgcagagctctgatgggcaggcctccgagggcctgtgctgtgtgctgttaggatagcttggtgttgtctataccccattagtaagttttgtctgagtgtgtcctcgctgttcattgtctaatttggtaacatttattttggtcctgaccccttctgctgctgctgggtttaagcttcagtgcaggtggaatgacattcaaataaagaaacactttctatcaccca

SEQ ID NO: 434487 - DNA, 2592 bp, Homo sapiens
tgtacggcccgagtcgttagatgggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434488 - DNA, 501 bp, Homo sapiens
aagggacaaatgcgcgcacttcaggaatctcctcttcagactctcgcatgatgagtgttgttctctgcggtccttcgaggcccttagcctcttttagcgatgcccagcttggaccaaagagcctcctctctcccattcctcatttccctgtgccagccctgtttcctctgtaaccacgagcaccttcccttgtctggtgctcatctgctgtcttccttcccagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434489 - DNA, 2592 bp, Homo sapiens
ggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434490 - DNA, 2632 bp, Homo sapiens
aagggggtacaggggccaggtgaagggacagatgaagagatcagaacagccttagagctcacgggctaactgggtgaaggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434491 - DNA, 2747 bp, Homo sapiens
aagggggtacaggggccaggtgaagggacagatgaagagatcagaacagccttagagctcacgggctaactgggtgaaggcttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434492 - DNA, 2825 bp, Homo sapiens
aagggggtacaggggccaggtgaagggacagatgaagagatcagaacagccttagagctcacgggctaactgggtgaaggcttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434493 - DNA, 2670 bp, Homo sapiens
ggggtgtggccaaagcgcagtagggggctctcgcggttggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434494 - DNA, 2399 bp, Homo sapiens
ggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcgctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434495 - DNA, 2550 bp, Homo sapiens
ggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctgcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434496 - DNA, 2440 bp, Homo sapiens
ggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434497 - DNA, 2454 bp, Homo sapiens
ggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcaatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434498 - DNA, 2514 bp, Homo sapiens
ggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaaggtgtcgagagggaaatgggtgcttcccttggagggtggggtgggaactgcgaatcaaagctcctgctgatatgccccgtctgcactttcaccccagccctgcaagaaaaggtggctgaagtggaaactcggctgcgggagcaactctcagacacagagaggaggctgaacgaggctcggagggagcatgccaaggccggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434499 - DNA, 801 bp, Homo sapiens
tgagaagtgggatctcactatattgcccaggctggacctgaactccttgaaatcctctcacctcagactcctgagtagctggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 434500 - DNA, 1076 bp, Homo sapiens
aagggggtacaggggccaggtgaagggacagatgaagagatcagaacagccttagagctcacgggctaactgggtgaaggcttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtagggatccatccacgccgttttctcaggcttgcttgctagtgacccttcctcactggaataaactccttaccctatttcggccctagtttccagaacgtactcatttttatgtaagcaattagttcctacagtgcataaataataaagcagtgtgctaagtgctagggatgaggataacaatagtgaataagacaaatcctgacttaaatttgtaattaataaggaatctaaaatcctaagaggggagatagattgaccaccagctgatggtaaagcatggtatgaggcaagatgaagaagtgcaaactagaggtagagacccagcactgtggcagtgtgggttcattctgatggaagaaagcctttacagaggacatgctgtgggagctggccatgctgtcgtattatctgtaaacattcttattcttgtttcatgtgtcttttcccagatgtactgggatatcattctgccattttgctccagaataggattacattagaagaagcagcatgatgaagaaggaatactagactgggtgtcaggagacagagactctatttctagtttggctaccagctagaggacatttggcaagtc

SEQ ID NO: 434501 - DNA, 186 bp, Homo sapiens
aggggcagcgactggcccggcgcttgcaggagctagagagggataagaacctcatgctggtaggagacaggagggcagacaggcagacactagggcccatcctgggctggttcctgggctagaggtgtggaaagaggatggtgagggaggctctatccgggctaggtttaaccctctccttcccag

SEQ ID NO: 434502 - DNA, 345 bp, Homo sapiens
ccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggacctggctataattcaaggattatgactttgttattgtaggggctttctctttggaaggtggcctgaaaattgaattggagtgtctttgtttctcctcttgtccaggggaacatagatggctgaagacagaatctagagccttcaaataatgtggagatgtttcc

SEQ ID NO: 434503 - DNA, 381 bp, Homo sapiens
cggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcaggtgaatgcaggggtagaaaggattcaaattcataacggagagctgggcagtagcttccaagcaaagaacaggtattgcagaaaagaccctccatgagtagtgagtagtagagtgatgagacctttggtgaaaataaacacacatgggctagaa

SEQ ID NO: 434504 - DNA, 1113 bp, Homo sapiens
  misc_feature (12)..(12): n is a, c, g, or t
  misc_feature (30)..(30): n is a, c, g, or t
gaaatctcaatnctcttttaaaaattggtntggctaaacagccaaggtgcagtggtgcagtctgaatagtccccagtgactcaggaggctgaggtgggaggatcactcgaactcctgacctcacgtgatccacctgccttggccttccaaagtgctgggattacaggcgtgagccactttacctggcctatcacctagctttgataacagcattttgccaatcttgcatctatacttctccatttttctacctctacctccctggaatattttaaagcaagcccagtcctcatgggatttcactcctaaatacttaagaacgtattaatacactcagggaatcttttagaggtgaggatgggagagtataatataactacagtggtattgtcacatctataaaattaataattgtttaactttgcttctcaaggctcttttctcagaaatgtctttttatggtttctttttttctaatcaacacccaaacaggtttcacatattccatttggttatttctctcttaaatccttaattaaaatagtttccaaaccctgtagtattttttgagggccaaatgagatatatttgtaggcttccaaagtgtttatacaaacataagttgtttggtcataggagagaaataacctttctaaaaatatatcagcattgcagtttagtgttaataacattaaagagaaatgagagaatgtagagatgcctgagtgatggagaaaaaagcaggaataatttggcattaaactaaggctgagatgtattaaaattgagccagtgtggagaagctggcctaggaccttctctgtagcatttatagccaagcaattaacctatatacccacccttgggtaataggttctcctctcttatagtacgtgccacacttccaagtgtagactgatgataatgaagacattggaataatgccctttgagagttttgccttagattgggaaatgcaggtctcaagattctcagacaaaatattttcttctagggaagagtacattttaatgttgtttccctgcccaaaaagataatgatatatataaatcatgggtatggattacaaaacgataatgtattcctacagta

SEQ ID NO: 434505 - DNA, 3870 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggaggaggctctggctgagttcctgcagcgaaaactggccagtttgaagccagccgaacgtacccaggccacactgctgaccacctggctgacagagctctacctgagccggcttggggctctgcagggcgacccagaggccctgactctctaccgagaaaccaaggaatgctttcgaaccttcctcagcagcccccgccacaaagagtggctctttgccagccgggcctctatccatgagctgctcgccagtcatggggacacagaacacatggtgtactttgcagtgatcatgcaggactatgagcgggtggtggcttaccactgtcagcacgaggcctacgaggaggccctggccgtgctcgcccgccaccgtgacccccagctcttctacaagttctcacccatcctcatccgtcacatcccccgccagcttgtagatgcctggattgagatgggcagccggctggatgctcgtcagctcattcctgccctggtgaactacagccagggtggtgaggtccagcaggtgagccaggccatccgctacatggagttctgcgtgaacgtgctgggggagactgagcaggccatccacaactacctgctgtcactgtatgcccgtggccggccggactcactactggcctatctggagcaggctggggccagcccccaccgggtgcattacgacctcaagtatgcgctgcggctctgcgccgagcatggccaccaccgcgcttgtgtccatgtctacaaggtcctagagctgtatgaggaggccgtggacctggccctgcaggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgca

SEQ ID NO: 434506 - DNA, 798 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcgggtaaggaagaggagggtgccgctgcccctttcggctctcctagcatttgcgtgggagcagcgaggagggcagctccaagagctcggggtcatcccctgggccgtgccttccgggtctaggcccctgattctcctcaggctctcttggcccccagctggtggatagtcgaagtttgaaagagcaacgggagctgccgcgtgatctaggctctaccgctagggtccttttgagagggaattggggcccagataaggaattactcacctacagggcgcagttgggctgttgggagaacttagaatgggctcccggcttctgctgatgcttttcccaccaggccccttctggaggtgggagggaaggaatggacaaagaaagtggtgaaggcggaga

SEQ ID NO: 434507 - DNA, 3838 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggatggccagtttgaagccagccgaacgtacccaggccacactgctgaccacctggctgacagagctctacctgagccggcttggggctctgcagggcgacccagaggccctgactctctaccgagaaaccaaggaatgctttcgaaccttcctcagcagcccccgccacaaagagtggctctttgccagccgggcctctatccatgagctgctcgccagtcatggggacacagaacacatggtgtactttgcagtgatcatgcaggactatgagcgggtggtggcttaccactgtcagcacgaggcctacgaggaggccctggccgtgctcgcccgccaccgtgacccccagctcttctacaagttctcacccatcctcatccgtcacatcccccgccagcttgtagatgcctggattgagatgggcagccggctggatgctcgtcagctcattcctgccctggtgaactacagccagggtggtgaggtccagcaggtgagccaggccatccgctacatggagttctgcgtgaacgtgctgggggagactgagcaggccatccacaactacctgctgtcactgtatgcccgtggccggccggactcactactggcctatctggagcaggctggggccagcccccaccgggtgcattacgacctcaagtatgcgctgcggctctgcgccgagcatggccaccaccgcgcttgtgtccatgtctacaaggtcctagagctgtatgaggaggccgtggacctggccctgcaggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgca

SEQ ID NO: 434508 - DNA, 1999 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgca

SEQ ID NO: 434509 - DNA, 3761 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggaggaggctctggctgagttcctgcagcgaaaactggccagtttgaagccagccgaacgtacccaggccacactgctgaccacctggctgacagagctctacctgagccggcttggggctctgcagggcgacccagaggccctgactctctaccgagaaaccaaggaatgctttcgaaccttcctcagcagcccccgccacaaagagtggctctttgccagccgggcctctatccatgagctgctcgccagtcatggggacacagaacacatggtgtactttgcagtgatcatgcaggactatgagcgggtggtggcttaccactgtcagcacgaggcctacgaggaggccctggccgtgctcgcccgccaccgtgacccccagctcttctacaagttctcacccatcctcatccgtcacatcccccgccagcttgtagatgcctggattgagatgggcagccggctggatgctcgtcagctcattcctgccctggtgaactacagccagggtggtgaggtccagcaggtgagccaggccatccgctacatggagttctgcgtgaacgtgctgggggagactgagcaggccatccacaactacctgctgtcactgtatgcccgtggccggccggactcactactggcctatctggagcaggctggggccagcccccaccgggtgcattacgacctcaagtatgcgctgcggctctgcgccgagcatggccaccaccgcgcttgtgtccatgtctacaaggtcctagagctgtatgaggaggccgtggacctggccctgcaggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttctccagtgtgaagggtgccctggggctgagggccttgtggaggatggtcggtggtggtgatggaggtggagagcattaaactgtctgcactgca

SEQ ID NO: 434510 - DNA, 2081 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggaggaggctctggctgagttcctgcagcgaaaactggccagtttgaagccagccgaacgtacccaggccacactgctgaccacctggctgacagagctctacctgagccggcttggggctctgcagggcgacccagaggccctgactctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgca

SEQ ID NO: 434511 - DNA, 1155 bp, Homo sapiens
caacaaacaatacagagaatttttaatgagacatgtcaggcatcgtggaaggctcttgcctgggtcacttatgtgatgacctcaacaaacccattttattatacaatgaaaaaagtgtacgaagcttacatatgatttttttttaagtttcttcctgccagagcatggattaaagaaactttagtaaagagtaaaaaattttaaaacacacagtttgatatgaattttggtaaaagttatcagagacaaatactagtgggccaacgaaaacactgtatttataggaaaatttgaattggggcaataaatatgtcctgaggctttggtggcatcaaagtattggtgctttattttttgtgatttattgttttatcaacagaagtgagcacttgtgttcagaaaaggataattcacacttaaatcttgtttttatttaatcaagcttaaataacaggttagagtggtagcaaaaaaaaaaaaaaaaagtctaatatttagtttgaatcttaaattggtcacccagagctgctctctctaggagcgaacctctctatttgtcaataaacaagagagagatacaggctcccagataacaggcatttggtaaactggcgacagtcatacaagcgagaatgttaaaatgacttcagctctttctagcttcattatgtcagcctggcagatcacatatggcattatggaaatcagcaaatgaaaaccatattgatcagcattgagaacaaatgtaaaaaaggtggtctcagggaggagcagagaagaagaatgctttcctgttcaacctgataggcccttgttaaggccttttaatcatttattaacataaccctccttcttccctctccactcagattacctcagccacagagcatcctgctccatttatcttttaatgcttcctttatttaatttatttttaagctctaagttatactcttatttcagaattgagttttacttttcatggtattgtttaaagtgacttaaatgacttttcccaacaagctcaccaggcattcaaaggaagaaaagcatttgctgagattcacctatcagcaaataatttactcggtatgcaccacaaacaaacgcagagagacagagaaagacagtcagccagacacattaaaaaaaaaa

SEQ ID NO: 434512 - DNA, 1303 bp, Homo sapiens
aacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaa

SEQ ID NO: 434513 - DNA, 476 bp, Homo sapiens
cgccaattgaattataatacggatacataataggggatattggggaccgggcccccccttcaattttgtagccaaaagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaa

SEQ ID NO: 434514 - DNA, 1447 bp, Homo sapiens
  misc_feature (1319)..(1319): n is a, c, g, or t
  misc_feature (1323)..(1323): n is a, c, g, or t
aacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaaaaaaaaaaacaaagancaanaaacacaagcaacaaaaaccaaaactccacaaaccataccacaaaccacggcccgcgcgcgcggaccgcacctcgccccgccaacgcgggcgcacccgtcaccgctgcacgacccccacacccg

SEQ ID NO: 434515 - DNA, 1809 bp, Homo sapiens
aacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaaaaaaaaaaacaactaacaaaacaaaaaacaacgaaccaaccacaccagaaacaaacacaacacccagaacaaacagaagagaaaaagcaccacacacaagccccgcccaccaagcaccgccgggcacacccgcacggacgcggcaagcacgaagcgaaaaggcacggacacacgaagcacagaggcggcagacagagaggcgagaaaccgacagggcgacgcgccgcagcgagacaaccgcagagaaggcggcaccagcagacgaaagagagcgacaagcacgagcaacaaaacagcaagaagcacgcccgcagcgaacaaaccagaggagagcccaggacgaagagcaacacaaaagcagaaacacgcgcgcaaaacacacgcgagaccgccgcaaagccacggaaaaccagagaagaacgcaaggaaggacgagacgaaggaagacaagaaagccaacgaagaagaagagagagagacaaagagaagaggccaaagagacccag

SEQ ID NO: 434516 - DNA, 1085 bp, Homo sapiens
aacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccggtgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaa

SEQ ID NO: 434517 - DNA, 779 bp, Homo sapiens
gggattgtgtctgtgaactgggaattaaagagtgaatcgtgatactacggtgcagttcattctggctgctgtaacaaaacacgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaa

SEQ ID NO: 434518 - DNA, 760 bp, Homo sapiens
aacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccaatgttccacaccatcgacaaccaaggggtgaggtggggacaggcctcagcagggaatggggcgtatatgttagtgttgctgcaacaataaagcctgttgcatctctcatgccaa

SEQ ID NO: 434519 - DNA, 855 bp, Homo sapiens
aacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttcgtgagtctccactaccccgagatagccaggaaagcagccagagcatgcttaaggcaccaggccagccctgccggtccccgggttgagagggggctgggaaacccgagggcctcgccacgcccccgctaaaagcgccttcccgggcttcgttcccccttctgggaacaccccttttattatcgcctttcctatctcactcttggtgttaagtgccttccactggccacgtccccgttaccgggcgtcttccctggccatgcccacgttgccaagccaattactcggccacgctttcagtatctgaggcgtcctggctgctcaccactccattggcctgcctgcgcgccaattcccttcggtgggccccggttggctgcaggctgaggtctattccactgacca

SEQ ID NO: 434520 - DNA, 343 bp, Homo sapiens
tgcaacaataaagcctgttgcatctctcatgccaatttgagcctcctgggtaaagtccttgtacatttcaaaggacagaagtggcctacttttcaattctgctagactcttcctgaatatgtgggctgaagaggtgatctctgaggcccttccttgaacttatgacctctggatcagcattaaagcacagggaaggacaggtgcagtggctcacgcctgtaattccaacactttgggaggctgagactagaggatcacttgaggctaggagtttgagaccaacctgggcaatatagcaagactcttattgctacaaaaaaattaaaatttagctgggcatggt

SEQ ID NO: 434521 - DNA, 18208 bp, Homo sapiens
  misc_feature (213)..(213): n is a, c, g, or t
  misc_feature (332)..(332): n is a, c, g, or t
  misc_feature (1677)..(1677): n is a, c, g, or t
  misc_feature (2522)..(2522): n is a, c, g, or t
  misc_feature (4612)..(4612): n is a, c, g, or t
  misc_feature (4860)..(4860): n is a, c, g, or t
  misc_feature (4864)..(4864): n is a, c, g, or t
  misc_feature (4937)..(4937): n is a, c, g, or t
  misc_feature (5221)..(5221): n is a, c, g, or t
  misc_feature (5291)..(5291): n is a, c, g, or t
  misc_feature (6104)..(6104): n is a, c, g, or t
  misc_feature (6107)..(6107): n is a, c, g, or t
  misc_feature (6446)..(6446): n is a, c, g, or t
  misc_feature (7482)..(7482): n is a, c, g, or t
  misc_feature (7600)..(7600): n is a, c, g, or t
  misc_feature (8843)..(8843): n is a, c, g, or t
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaaganggggaaaaaaaagaaaatgatttcctgggaagttgtccatacagtattcctgtttgctcttctttattcttccctagctcaagatgcgagcccccagtcagagatcagagctgaggaanttcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgancttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatntggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaangaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatantccncctagtattaaaggaggaaatgtcaccacagacatatcagtattgatcaacagccttattaaactggaatgtnaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaangctgctggaaacccttctcccattctcacctggttgaaagatggtgtacctgtgaaagctaatgacaatntccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatngtntactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtncacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccanaacctggttcaaagatgggtggcctgtcagccttagcaattctgtgaggattctttcaggaggcaggatgctacggctgatgcagaccacaatggaagatgctggccaatatacttgngttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcnagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggacattaatgaatgtgaacaagtgcctaaaccttgtgcacatcagtgctccaacacccccggcagcttcaagtgtatctgtccaccaggacaacatttattaggggacgggaaatcttgcgctggattggagaggctgccaaattatggcactcaatacagtagctataaccttgcacggttctcccctgtgagaaacaactatcaacctcaacagcattacagacagtactcacatctctacagctcctactcagagtatagaaacagcagaacatctctctccaggactagaaggactattaggaaaacttgccctgaaggctctgaggcaagccatgacacatgtgtagatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataa

SEQ ID NO: 434522 - DNA, 17857 bp, Homo sapiens
  misc_feature (213)..(213): n is a, c, g, or t
  misc_feature (332)..(332): n is a, c, g, or t
  misc_feature (1677)..(1677): n is a, c, g, or t
  misc_feature (2522)..(2522): n is a, c, g, or t
  misc_feature (4612)..(4612): n is a, c, g, or t
  misc_feature (4860)..(4860): n is a, c, g, or t
  misc_feature (4864)..(4864): n is a, c, g, or t
  misc_feature (4937)..(4937): n is a, c, g, or t
  misc_feature (5221)..(5221): n is a, c, g, or t
  misc_feature (5291)..(5291): n is a, c, g, or t
  misc_feature (6104)..(6104): n is a, c, g, or t
  misc_feature (6107)..(6107): n is a, c, g, or t
  misc_feature (6446)..(6446): n is a, c, g, or t
  misc_feature (7482)..(7482): n is a, c, g, or t
  misc_feature (7600)..(7600): n is a, c, g, or t
  misc_feature (8843)..(8843): n is a, c, g, or t
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaaganggggaaaaaaaagaaaatgatttcctgggaagttgtccatacagtattcctgtttgctcttctttattcttccctagctcaagatgcgagcccccagtcagagatcagagctgaggaanttcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgancttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatntggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaangaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatantccncctagtattaaaggaggaaatgtcaccacagacatatcagtattgatcaacagccttattaaactggaatgtnaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaangctgctggaaacccttctcccattctcacctggttgaaagatggtgtacctgtgaaagctaatgacaatntccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatngtntactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtncacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccanaacctggttcaaagatgggtggcctgtcagccttagcaattctgtgaggattctttcaggaggcaggatgctacggctgatgcagaccacaatggaagatgctggccaatatacttgngttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcnagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataa

SEQ ID NO: 434523 - DNA, 17803 bp, Homo sapiens
  misc_feature (213)..(213): n is a, c, g, or t
  misc_feature (332)..(332): n is a, c, g, or t
  misc_feature (1677)..(1677): n is a, c, g, or t
  misc_feature (2522)..(2522): n is a, c, g, or t
  misc_feature (4612)..(4612): n is a, c, g, or t
  misc_feature (4860)..(4860): n is a, c, g, or t
  misc_feature (4864)..(4864): n is a, c, g, or t
  misc_feature (4937)..(4937): n is a, c, g, or t
  misc_feature (5221)..(5221): n is a, c, g, or t
  misc_feature (5291)..(5291): n is a, c, g, or t
  misc_feature (6104)..(6104): n is a, c, g, or t
  misc_feature (6107)..(6107): n is a, c, g, or t
  misc_feature (6446)..(6446): n is a, c, g, or t
  misc_feature (7482)..(7482): n is a, c, g, or t
  misc_feature (7600)..(7600): n is a, c, g, or t
  misc_feature (8843)..(8843): n is a, c, g, or t
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaaganggggaaaaaaaagaaaatgatttcctgggaagttgtccatacagtattcctgtttgctcttctttattcttccctagctcaagatgcgagcccccagtcagagatcagagctgaggaanttcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgancttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatntggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaangaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatantccncctagtattaaaggaggaaatgtcaccacagacatatcagtattgatcaacagccttattaaactggaatgtnaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaangctgctggaaacccttctcccattctcacctggttgaaagatggtgtacctgtgaaagctaatgacaatntccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatngtntactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtncacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccanaacctggttcaaagatgggtggcctgtcagccttagcaattctgtgaggattctttcaggaggcaggatgctacggctgatgcagaccacaatggaagatgctggccaatatacttgngttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcnagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataa

SEQ ID NO: 434524 - DNA, 17485 bp, Homo sapiens
  misc_feature (213)..(213): n is a, c, g, or t
  misc_feature (332)..(332): n is a, c, g, or t
  misc_feature (1677)..(1677): n is a, c, g, or t
  misc_feature (2522)..(2522): n is a, c, g, or t
  misc_feature (4612)..(4612): n is a, c, g, or t
  misc_feature (4860)..(4860): n is a, c, g, or t
  misc_feature (4864)..(4864): n is a, c, g, or t
  misc_feature (4937)..(4937): n is a, c, g, or t
  misc_feature (5221)..(5221): n is a, c, g, or t
  misc_feature (5291)..(5291): n is a, c, g, or t
  misc_feature (6104)..(6104): n is a, c, g, or t
  misc_feature (6107)..(6107): n is a, c, g, or t
  misc_feature (6446)..(6446): n is a, c, g, or t
  misc_feature (7482)..(7482): n is a, c, g, or t
  misc_feature (7600)..(7600): n is a, c, g, or t
  misc_feature (8843)..(8843): n is a, c, g, or t
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaaganggggaaaaaaaagaaaatgatttcctgggaagttgtccatacagtattcctgtttgctcttctttattcttccctagctcaagatgcgagcccccagtcagagatcagagctgaggaanttcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgancttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatntggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaangaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatantccncctagtattaaaggaggaaatgtcaccacagacatatcagtattgatcaacagccttattaaactggaatgtnaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaangctgctggaaacccttctcccattctcacctggttgaaagatggtgtacctgtgaaagctaatgacaatntccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatngtntactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtncacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccanaacctggttcaaagatgggtggcctgtcagccttagcaattctgtgaggattctttcaggaggcaggatgctacggctgatgcagaccacaatggaagatgctggccaatatacttgngttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcnagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataa

SEQ ID NO: 434525 - DNA, 427 bp, Homo sapiens
tgcaaagtgatgttagaatgattgtgatcctatatctttaaaagaaccaataaaggtattcagtatatgtcctgataattgatgaatgtaaacagtgtgctggcctgttttatcctgaaagaaaacccatctttcatgtagttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaaggtaaggatatggattcatttattttaccttatgttattagaagttcatggttttggtattaccctatttagcgtgactgtcttttataagtgttggactaattttctctt

SEQ ID NO: 434526 - DNA, 1533 bp, Homo sapiens
ctagaattcagcggccgctgaattctagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttagttgttcagctaaactttgagaagaatttaattatgtctcatgaggtatcaaactatgtaattttgtccttgttatttttgtttcctttgtaatttacttgatgagtttatatcttcattaaagaatgttattataaagtgaaaaa

SEQ ID NO: 434527 - DNA, 1102 bp, Homo sapiens
tttcaaacagggagccccctgtttgctaccaggctgtatacttaaccacactgtgctacattgatccatgtgttatgattttactgcatgaaaacgtggcctcttttccagctcctgacagtcacatgggagaaagtgggtgagggcaggtactggctggtctttcagctgaataggagttgtgtctgtttgcttcctaggtcagttgacttgctttattatatacttttaaaaactgaagttttttttaaatcaaaaactaatgacaagtaatgtttatttgtatttatcagagctcgcaaattatgtcattggtcttctgtgaagtagaggacttcacagttttatggtgttattttgctaaatagaatggtattttgaaatccaatgaggattttagggagataatttaagacattatgtgttctacagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttagttgttcagctaaactttgagaagaatttaattatgtctcatgaggtatcaaactatgtaattttgtccttgttatttttgtttcctttgtaatttacttgatgagtttatatcttcattaaagaatgttattataaagtgaaaaa

SEQ ID NO: 434528 - DNA, 870 bp, Homo sapiens
tttcaaacagggagccccctgtttgctaccaggctgtatacttaaccacactgtgctacattgatccatgtgttatgattttactgcatgaaaacgtggcctcttttccagctcctgacagtcacatgggagaaagtgggtgagggcaggtactggctggtctttcagctgaataggagttgtgtctgtttgcttcctagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttagttgttcagctaaactttgagaagaatttaattatgtctcatgaggtatcaaactatgtaattttgtccttgttatttttgtttcctttgtaatttacttgatgagtttatatcttcattaaagaatgttattataaagtgaaaaa

SEQ ID NO: 434529 - DNA, 570 bp, Homo sapiens
taagaaaaagggttttgttttttattatgtttattcagtgtagtacattttgctgtaacaagttagaagaaaagtggagatatttcttcacattaatttttatattcttttccatcataggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttagttgttcagctaaactttgagaagaatttaattatgtctcatgaggtatcaaactatgtaattttgtccttgttatttttgtttcctttgtaatttacttgatgagtttatatcttcattaaagaatgttattataaagtgaaaaa

SEQ ID NO: 434530 - DNA, 760 bp, Homo sapiens
gggcaggcaaaaggagcttggcagattgtgtgtcagttatagcacgtctggaccgtcacttctgtttgctttcatgggctggagctccatgcatggccacagctaaccacaagggagccaggaaactggctatttatccaggaagcagaggagatactgaacagctagcaggtctctgccacaatgtctattgataacgtatgtcagatgtcacagaagaaaatatggtagttcttaatgagaatgccatagattattcttaaaattcatagatgtatacaaatgttaacaatcttaatggtattttagggatgcggaaaaggcaaatttgtatccataagtatggtgtcatttttttgtcttttaggaatatgtgtttttaaccttattttaaattattttaatttgtagggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttagttgttcagctaaactttgagaagaatttaattatgtctcatgaggtatcaaactatgtaattttgtccttgttatttttgtttcctttgtaatttacttgatgagtttatatcttcattaaagaatgttattataaagtgaaaaa

SEQ ID NO: 434531 - DNA, 1688 bp, Homo sapiens
ctagaattcagcggccgctgaattctagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactgtgtgagctaccacgccttgcctgagttgatcttctacaagagttcaaacaaaaaacagaccataccaggatgatcacttcaaacatgaggatgggtataagctgacgtcagacacagcagggttgatgggagacctacagaaaatacatataaatcatcagacatgaagtccagcacatagtaggtattgaataaatggcagtgagtggtcatgtccagaaatgaagccaagaagttgagcctggactactaagaatctggtctgaagaatttcaaaaaggagaatggttctccctgataacaaatagtgatgagtaaaaccagacaaattacatatgcctcccccaagtatgtacgtttggaatcaacttggtggttttcttcagagaaaaaatgtttcatgtctgcctcccacatttaattctccaacgtctttctgaaattatttcagaatgaaatgaggcagcatacttgaggttaaattcaataaaaaatatctgaag

SEQ ID NO: 434532 - DNA, 2037 bp, Homo sapiens
ctagaattcagcggccgctgaattctagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactgtgtgagctaccacgccttgcctgagttgatcttctacaagagttcaaacaaaaaacagaccataccaggatgatcacttcaaacatgaggatgggtataagctgacgtcagacacaggtacggtgccaaaccctgggatctctctctttaactgagagtcagggagggctgattgcttctattctcagaagatgggagaacgtatgctgttagcagaaatgtaagaggcagtaaagaaatactaataggatgatggcagaagctttacagaaaatgttcctcagggatgaattaaggtttttccaaagtaacctgacagcacattatggaaagcaactgggttttgggtgtgggcagtctttagatcaaattctggcagttctgttcattggctttgtaatattagaatgttaatgttcttgaattgcaatgtttttaatgtataaattgtcaaaatgtttttcagcagggttgatgggagacctacagaaaatacatataaatcatcagacatgaagtccagcacatagtaggtattgaataaatggcagtgagtggtcatgtccagaaatgaagccaagaagttgagcctggactactaagaatctggtctgaagaatttcaaaaaggagaatggttctccctgataacaaatagtgatgagtaaaaccagacaaattacatatgcctcccccaagtatgtacgtttggaatcaacttggtggttttcttcagagaaaaaatgtttcatgtctgcctcccacatttaattctccaacgtctttctgaaattatttcagaatgaaatgaggcagcatacttgaggttaaattcaataaaaaatatctgaag

SEQ ID NO: 434533 - DNA, 1290 bp, Homo sapiens
ctagaattcagcggccgctgaattctagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggtgtctttgccttttggaaacttatccgtatctgagtacaaacactactttgaccaggttgtttacctctgactcaaaatcttcctgggggtgtcattgccaatgtagtgataacatcagtctctggaacttcttattatcatattctttattctttttccccctaaagtaaaaattctttttacagattagaaaaatttatgttag

SEQ ID NO: 434534 - DNA, 946 bp, Homo sapiens
agatgaggtcttgctatgttgcccaggctggtctcaaactcttgagctcaagcaatcctcctgcctcggccttctaaaatgttgtgattacaggtgtgagctaccacgccttgcctgagttgatcttctacaagagttcaaacaaaaaacagaccataccaggatgatcacttcaaacatgaggatgggtataagctgacgtcagacacaggtacggtgccaaaccctgggatctctctctttaactgagagtcagggagggctgattgcttctattctcagaagatgggagaacgtatgctgttagcagaaatgtaagaggcagtaaagaaatactaataggatgatggcagaagctttacagaaaatgttcctcagggatgaattaaggtttttccaaagtaacctgacagcacattatggaaagcaactgggttttgggtgtgggcagtctttagatcaaattctggcagttctgttcattggctttgtaatattagaatgttaatgttcttgaattgcaatgtttttaatgtataaattgtcaaaatgtttttcagcagggttgatgggagacctacagaaaatacatataaatcatcagacatgaagtccagcacatagtaggtattgaataaatggcagtgagtggtcatgtccagaaatgaagccaagaagttgagcctggactactaagaatctggtctgaagaatttcaaaaaggagaatggttctccctgataacaaatagtgatgagtaaaaccagacaaattacatatgcctcccccaagtatgtacgtttggaatcaacttggtggttttcttcagagaaaaaatgtttcatgtctgcctcccacatttaattctccaacgtctttctgaaattatttcagaatgaaatgaggcagcatacttgaggttaaattcaataaaaaatatctgaag

SEQ ID NO: 434535 - DNA, 803 bp, Homo sapiens
ctagaattcagcggccgctgaattctagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggtaagaatgagattttaaagttgctttttctttcccacttctaatcttcataggatgagatgtttgggataagaaaagagaaaaaaaattgggtcagtgttttgctttttcatcgtgttagttgattccattttgggagcataatttctgccttaagttaatagaacatcatataactgttggacattaaatacttagatagaactgaataaatactatgcaaggtaatacagttgtctctcagtatccgtgggggattgggtccaggaccccttgctgataaccaaaattcacagatactcaagtcccttatataaaataaaatgatgtagcacttgcatgtaacctatatacatcctccc

SEQ ID NO: 434536 - DNA, 882 bp, Homo sapiens
ctagaattcagcggccgctgaattctagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaaggtagttttattttttattttttctttttttaaacatagatgcttttatattggctttgttaaaaatgcaacttgtcaacatatctgagaataagacatcgaatgtgtctgagttacattgttcttattaatttaatgaaaaggtaatactaatgaattgattggataggatagctgaagccacaagtaacaaaactgactacaattaact

SEQ ID NO: 434537 - DNA, 614 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaaggtgagtctcctagctctattttctgggtttttaactggtccctactaattttttacttgtagaaactaattaaaaaaaaaaaacactaatggccattgtgactttttctttcagttttgtgtactactccaaataagtatgttgtcgttgatgctgcaggtgcagtaaagcctcagtgttgtgtggatatgtaagtcaagatcaattcctggtaacacgttttaagtgtgttaatatttatgtttttaacttgaaaaaaaaaa

SEQ ID NO: 434538 - DNA, 1100 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtagtttggggttgttttaaagcccttttgaggtcttacacattattaactttaaaataatcaggcagctaagaataattactagaaaaatcatctaccacttcaaacatggtcaactacttcaaaactgcacctagagaatcaggtacctgaagtagaacaagaagcctggaggtggactttgagaggagggaatacccctcactggaccaggctgtaaggagcgggtagatgttgctgtagccttttaaatatatctgtatttaaacataaacataaatatatctaagactgcaggcaccatactttatgaagctagtacaatttggcagttcctatacttttgtttccatgactttcctatatcctttctcatttaattagttccaaggaagagagagattgtgtttggcaataggccaagcttagtgcactgttcatattattttgaaaaa

SEQ ID NO: 434539 - DNA, 884 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatatgtaagtcaagatcaattcctgtgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtagtttggggttgttttaaagcccttttgaggtcttacacattattaactttaaaataatcaggcagctaagaataattactagaaaaatcatctaccacttcaaacatggtcaactacttcaaatgcctagagatagtctgagtgaaaaaagccgggggggtggaggggggaacccccctggcaccggtagaggcggaatgggctaattggtgacc

SEQ ID NO: 434540 - DNA, 2611 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434541 - DNA, 2449 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434542 - DNA, 2733 bp, Homo sapiens
agcggggtctcccagcaggcagtgcagcctagggacgctgacaaaggagcggaggagcagtcgcagctgctttccgaggaagccggtgttgccgagatggagtctcactctgtctcccaggttggagtgcagtggcatgatctcggctcactgcaacctccgcctcccgggttcaagtgattctcctgcctcagcctccctagtagctgggattacagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434543 - DNA, 2380 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaaaaagtcgacgcggccgcgaatttagtagtagta

SEQ ID NO: 434544 - DNA, 2234 bp, Homo sapiens
ggtcgggggagttggtgaccacctttcagtaagaactcactacctcacaatgccacgtcagcattccatcctgcaatgattcagaccagttaagacatgggcttccacatcagcccagcagttaactctcagatggaaaaaatgatggggaaacaattggagaagttagacaaaatcagaatactggtctgtggtggccagtgtttgtgaaggaacttttgtcttaaagtttttagaaggaagcttagggatttttgtctttttacagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434545 - DNA, 2535 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagtgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434546 - DNA, 2470 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatatgtaagtcaagatcaattcctgtgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434547 - DNA, 2584 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaaggtgagtctcctagctctattttctgggtttttaactggtccctactaattttttacttgtagaaactaattaaaaaaaaaaaacactaatggccattgtgactttttctttcagttttgtgtactactccaaataagtatgttgtcgttgatgctgcaggtgcagtaaagcctcagtgttgtgtggatatgtaagtcaagatcaattcctgtgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434548 - DNA, 2383 bp, Homo sapiens
  misc_feature (2335)..(2335): n is a, c, g, or t
  misc_feature (2355)..(2355): n is a, c, g, or t
  misc_feature (2358)..(2358): n is a, c, g, or t
  misc_feature (2361)..(2361): n is a, c, g, or t
  misc_feature (2368)..(2368): n is a, c, g, or t
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacatcacttggttaaaaagacnaattaaacaccactctaccnttnttnaacaaantaacatgaattagcc

SEQ ID NO: 434549 - DNA, 2583 bp, Homo sapiens
agcggggtctcccagcaggcagtgcagcctagggacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcatgtgtgtgtgtaataacacattgtaaagaacagaaattactttaaaaaataaacagaaatggagacctgagcttcaaaaaaaaaaaaaaaaacagaacaaagaaaaaacaaaacaagaaaaaaaaaagaaaaaaaaaaaaaaaaaaagacagacacaagagaagagaaacaacagaaagaagaagaggaggcgcggagggagagaggacgagaaggagaacaaaaaaaaaaaagaagaggaacgacaaagaaatagaaaaaacaaaaggataacaataaaaatagaaatacagacagaaaacaaaggagagag

SEQ ID NO: 434550 - DNA, 1941 bp, Homo sapiens
aggggggtgctctcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccgccaccgcctccacccccgccgccccgccaccgccgccagctcccgggcaccatgcgaaccgccccgagcctccgccgctgcgtctgcctgctgctcgccgcgatcctggacctggcgcgcggctacctgacagtcaacattgagcctctcccccctgtggtggctggagacgccgtgactttgaagtgtaacttcaagacagatgggcgcatgcgggagatcgtgtggtaccgggtgacggatggtggcaccatcaagcaaaagatcttcaccttcgacgccatgttctccaccaactactcacacatggagaactaccgcaagcgagaggacctggtgtaccagtccactgtgaggctgcccgaggtccggatctcagacaatggtccctatgagtgccatgtgggcatctacgaccgcgccaccagggagaaggtggtcctggcatcaggcaacatcttcctcaacgtcatggctcctcccacctccattgaagtggtggctgctgacacaccagcccccttcagccgctaccaagcccagaacttcacgctggtctgcatcgtgtctggaggaaaaccagcacccatggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctggttgcccccaaaggacccaaaattgtgatgacgcccagcagagcccgggtaggggacacagtgaggattctggtccatgggtttcagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttgaaaacccaaatatcccaagaggaacggaggactctaatggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccca

SEQ ID NO: 434551 - DNA, 1418 bp, Homo sapiens
tgcacccagcccatgttcacattttaattgtggaagccaggtgacggatggtggcaccatcaagcaaaagatcttcaccttcgacgccatgttctccaccaactactcacacatggagaactaccgcaagcgagaggacctggtgtaccagtccactgtgaggctgcccgaggtccggatctcagacaatggtccctatgagtgccatgtgggcatctacgaccgcgccaccagggagaaggtggtcctggcatcaggcaacatcttcctcaacgtcatggctcctcccacctccattgaagtggtggctgctgacacaccagcccccttcagccgctaccaagcccagaacttcacgctggtctgcatcgtgtctggaggaaaaccagcacccatggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctggttgcccccaaaggacccaaaattgtgatgacgcccagcagagcccgggtaggggacacagtgaggattctggtccatgggtttcagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttgaaaacccaaatatcccaagaggaacggaggactctaatggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccca

SEQ ID NO: 434552 - DNA, 1705 bp, Homo sapiens
aggggggtgctctcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccggcaaccggctttcacccaaattatcttctcaccatggtgggaaactatcggcgagcgcagaggggcccctgggtgtgtcccgtccccctgtgtaggcgtgcccgagggtgcccgggatctcctcgaccacatgggtgccctttattgtagttgtccctgtggggcgactctatcgagcagcgcccaccccggggagaaggtggtcctggcatcaggcaacatcttcctcaacgtcatggctcctcccacctccattgaagtggtggctgctgacacaccagcccccttcagccgctaccaagcccagaacttcacgctggtctgcatcgtgtctggaggaaaaccagcacccatggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctggttgcccccaaaggacccaaaattgtgatgacgcccagcagagcccgggtaggggacacagtgaggattctggtccatgggtttcagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttgaaaacccaaatatcccaagaggaacggaggactctaatggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccca

SEQ ID NO: 434553 - DNA, 901 bp, Homo sapiens
gaccccactgtccactgggcctctctgatcttgtccctcatggcactggcttgtacttgtctgttgtttgtctttcttccccactgatgtgtgaaccccccaagagcaggaatcatgtcctatatacacccttgactccccaggtcctagagagcatctgattcattgcatgggcttagggaatatgtctgaatgaatgcagctgtgaatgagtgaatgaatgaatgagcacactgagcttctcacagaagcagctgatcccaaggatgttgattgctagactagaactttctcttccatgtaccctgtccctcctttccttactctctctgacctggcctttctctccctacagttgcccccaaaggacccaaaattgtgatgacgcccagcagagcccgggtaggggacacagtgaggattctggtccatgggtttcagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttgaaaacccaaatatcccaagaggaacggaggactctaatggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccca

SEQ ID NO: 434554 - DNA, 3471 bp, Homo sapiens
  misc_feature (594)..(594): n is a, c, g, or t
  misc_feature (669)..(669): n is a, c, g, or t
  misc_feature (1723)..(1723): n is a, c, g, or t
taacagaggataatgttaacggaaattgtgtagtcaagagttaaaatctggccaaaataatctgaccagatagttatatagttaggctacattctatcaagaaacataaaggaatagagatattttaaatgttgtgatattccttatttataatccccttcatagtacttttcatactgtactataatataatgtatctgtttacttgtctgtatccccctctaggctgtaagttccttgaagaaagaaagaactctctcccattctctcttatagtagaagttagcatagaggtgcctggcatataggtggccagacacctattcaaaccctgtagaatgaatgcttttacagctagtaaacagaccaaagcccatacccaatatcatatgctgcatattgtcaatagaaatactggaggagcaactgggaagcaggcactcagaaattttttttgagtggtaaagagggtcctgatcttagatgctttcagtcagagctgcagtatacagttggataggttgttcactgcacaaggttaaccagctaagggcactaattggggcagaaaatccagcctgtattctacttganaagccatcaactccaacaccgctctgtatctgcccacaggaagcaatgccttttttcaaattcctacaaaggccntgtacaaacttcagatagtcttgatttaaataatgacagagtaataatgtctgacaggttacatctcaggagcaagaaaaattgccctaccaatctgattccaccagagagtaaaagaaatagtgaagactgtctattcttaaaatgaaaacactgaggttggagatggtttttctctggattctcaacatagggtgatgtgcttacaaaataattttttttaaataaaaaagacccacataagggagcctctgtattcaacttgatcccagaatatgagttacagaatcagagatgcataaaaatctggaagaaaccttaaagttcatagaattccattgctagaaggaactttagatatcatctggtccaagaatcttaattttacagatgaggaaaccaaaaagatcaggaagattatgtgatttgcctgtggatggttagcaaagctaaatctagaacctggttgttttctacctctcaatcgaacactctttaccacagctggttggacttgacatcattataatcaactaagactgattgcgcacccactgtgtgggagaggctgacatggacttggtttccatcaagggcctagcaatgaggttgagaaaacaggaaatccaagcatcaaaagataagtaataatatgagatggcatatgaagcaaggtttagattccagtttcccagtgggagtggtgacaccaaggtgagtgatgggtgtggggtggagtgccctcgtatccacccacctatgcgtcctggttctgtctggaggcaccagggccaggtgacaaaacgtccaggcgaggccgcagtagggcctaaggtcaaaaagagcaatgctgaatcctacatcctggggccctcctaacacgtagcttaaggctctgggctcatgacccacattgtaaggatgagtggggtaaagcctatccacatctgggctgtgaattccagaagcgggggaccgaggcagctgtgcatgaagaccgcaaggaaggaggaagggagccgaggaggcccaagagcggcgggcgacctgacancaccctgccctcccagccagaggggcaggggggaaccccgcgcgcggcgccggtgcagcccgggcttccggggcggcgcacgcggccggggggcggggcgggggccgaagcaccgcctacgtcgggctgcgtgacaatggggccggcggcagaacgcagctgcggcggctgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgactttagctccgccgagtcgggctcctcgctgcgctactacagcgagggtgagagcggcggcggcggcggcggcagctccttgtcgctgcatccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatggtaagatcaattgatacatttaatatattctacaaaccaagtaagttgttgataaagtttagagtggtttgtaaatttgacataataattcaggaggtttagaattagaaaatttgatttttttaaacatttgattattctagaatttaaaaattaactactataaatatctgaactatctcaatttttattttaatatgtatggtaagtgtcatgatattaacacagtttactataaatgtacagattgttacaatgcactccctatttaatcttttttagtaattttttagttatcaaaggaaattgaacttaacccaaaaattccttgttgttatatcaagacaagtttcattaatatttcaatgttcttttcctgaagttcaaaaaaaaa

SEQ ID NO: 434555 - DNA, 6208 bp, Homo sapiens
  misc_feature (733)..(733): n is a, c, g, or t
  misc_feature (752)..(752): n is a, c, g, or t
gccattccctgtagcaggattaatcatttataaaataaagtccctatccattacttgcttcacataactttttttatgtgaaatagtgttttattgaattaagttccatatctgagttttttagataacatattgattttaaaatctgagtgttataattcttcaaacaaataaagtttgtcttggagaccttcaaattagcttttcctttttgcaatagctgttcatagtttcaagttgagtcgaaaccatgtggactggcacagtgtgggatgaagtatatctttatagtgatgcaacaacatctaaaattgcaagaacagttacccaaaaactggggattttctaaaggtaattgttaaatattactagagcttatcaaaattttgggaatctgactttctctcatattcaaaatagacaattcatattctgtttttagtatgttttaagtatattaaatttagtgacagattcctttttaaatgaaacttttattaagttgattgagttgacatgtgttcatcaaggaataattattatatatttagaatgatttgacaaaattaataaatatcttttatacttctaaaagcacaaaagctgttaaacctaaaatgtggcagttgaaatatagtgtcaaggaagatgaggactgaaagttttccattgtatttagtgatctggaggtcactggtgacttagatggattgatggggcagaaaccagatcngcatgggttgaagcgtaantagaaggtgaagcaatggaagcaatgagaatagacaactcctttttttttttcttcttttatttttaagatggggtctcactctgtctcccaggctggagtacagtggtgtgatcatagcacatcataacctggaactaattcctgggctcaagcaatcctccaaactcagcctcctcagtaactaggattacagggatgcatcactatgcccagctaattttttttatttttttgtagaaacggagtctccttgtgttgtccaggctggtctcaaatttttgggcacaagccatcctctcgccttggtctcccaaagctctggggttacaggcttgaaatacagtgcctggcctgacaactgtttagagaagtttgactaaatgaaagaaaagagagaatgatacctgggaaagatgtgagagcattatcaaaaaataaatgtaaaaagaattttaaagtttgataaaatttttatatcctattttaaaattttaatttcatcaataagtgtgctttgaatatctttttatgtttattagttatatttattttgaattaccttccataactttaacttattttgctatttgaatggttgtctttactttttaattagtaagctctctctgtatacttaagtaattatgtgttatattttgcatatttttttccagtttgccatttcttttttcctgatattttcttattataatatagaagctttaaatttttatatattcagtttgtccttctttccttccatttctttctctttatggtttctggctttggtgttgtgtccagttcactttatatcacagctgatcaatatataccttcttacagtttttatttcctcccccacagccagtgaaattttttcataatattccttttacttcttttttttcttttaacatattgtggaaatgctatttctcagattaaatagtaaacttagaattataatttttctacgcatcaagtagtgggtaccagacttcatagaggttatgtaggaggaagccacattaggaggacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataacaaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcataaaaaaaaagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcaggaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatcc

SEQ ID NO: 434556 - DNA, 522 bp, Homo sapiens
  misc_feature (468)..(468): n is a, c, g, or t
  misc_feature (476)..(476): n is a, c, g, or t
gccattccctgtagcaggattaatcatttataaaataaagtccctatccattacttgcttcacataactttttttatgtgaaatagtgttttattgaattaagttccatatctgagttttttagataacatattgattttaaaatctgagtgttataattcttcaaacaaataaagtttgtcttggagaccttcaaattagcttttcctttttgcaatagctgttcatagtttcaagttgagtcgaaaccatgtggactggcacagtgtgggatgaagtatatctttatagtgatgcaacaacatctaaaattgcaagaacagttacccaaaaactggggattttctaaaggcatcaagtagtgggtaccagacttcatagaggttatgtaggaggaagccacattaggaggacaagccatcacagactacccatattgtatttgttgtgcatggcattggggccggnaaatgggncccagggaggatttttccaaaattaccggctttgggtgggggggta

SEQ ID NO: 434557 - DNA, 9065 bp, Homo sapiens
  misc_feature (594)..(594): n is a, c, g, or t
  misc_feature (669)..(669): n is a, c, g, or t
  misc_feature (1723)..(1723): n is a, c, g, or t
  misc_feature (3590)..(3590): n is a, c, g, or t
  misc_feature (3609)..(3609): n is a, c, g, or t
taacagaggataatgttaacggaaattgtgtagtcaagagttaaaatctggccaaaataatctgaccagatagttatatagttaggctacattctatcaagaaacataaaggaatagagatattttaaatgttgtgatattccttatttataatccccttcatagtacttttcatactgtactataatataatgtatctgtttacttgtctgtatccccctctaggctgtaagttccttgaagaaagaaagaactctctcccattctctcttatagtagaagttagcatagaggtgcctggcatataggtggccagacacctattcaaaccctgtagaatgaatgcttttacagctagtaaacagaccaaagcccatacccaatatcatatgctgcatattgtcaatagaaatactggaggagcaactgggaagcaggcactcagaaattttttttgagtggtaaagagggtcctgatcttagatgctttcagtcagagctgcagtatacagttggataggttgttcactgcacaaggttaaccagctaagggcactaattggggcagaaaatccagcctgtattctacttganaagccatcaactccaacaccgctctgtatctgcccacaggaagcaatgccttttttcaaattcctacaaaggccntgtacaaacttcagatagtcttgatttaaataatgacagagtaataatgtctgacaggttacatctcaggagcaagaaaaattgccctaccaatctgattccaccagagagtaaaagaaatagtgaagactgtctattcttaaaatgaaaacactgaggttggagatggtttttctctggattctcaacatagggtgatgtgcttacaaaataattttttttaaataaaaaagacccacataagggagcctctgtattcaacttgatcccagaatatgagttacagaatcagagatgcataaaaatctggaagaaaccttaaagttcatagaattccattgctagaaggaactttagatatcatctggtccaagaatcttaattttacagatgaggaaaccaaaaagatcaggaagattatgtgatttgcctgtggatggttagcaaagctaaatctagaacctggttgttttctacctctcaatcgaacactctttaccacagctggttggacttgacatcattataatcaactaagactgattgcgcacccactgtgtgggagaggctgacatggacttggtttccatcaagggcctagcaatgaggttgagaaaacaggaaatccaagcatcaaaagataagtaataatatgagatggcatatgaagcaaggtttagattccagtttcccagtgggagtggtgacaccaaggtgagtgatgggtgtggggtggagtgccctcgtatccacccacctatgcgtcctggttctgtctggaggcaccagggccaggtgacaaaacgtccaggcgaggccgcagtagggcctaaggtcaaaaagagcaatgctgaatcctacatcctggggccctcctaacacgtagcttaaggctctgggctcatgacccacattgtaaggatgagtggggtaaagcctatccacatctgggctgtgaattccagaagcgggggaccgaggcagctgtgcatgaagaccgcaaggaaggaggaagggagccgaggaggcccaagagcggcgggcgacctgacancaccctgccctcccagccagaggggcaggggggaaccccgcgcgcggcgccggtgcagcccgggcttccggggcggcgcacgcggccggggggcggggcgggggccgaagcaccgcctacgtcgggctgcgtgacaatggggccggcggcagaacgcagctgcggcggctgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgactttagctccgccgagtcgggctcctcgctgcgctactacagcgagggtgagagcggcggcggcggcggcggcagctccttgtcgctgcatccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtgggatgaagtatatctttatagtgatgcaacaacatctaaaattgcaagaacagttacccaaaaactggggattttctaaaggtaattgttaaatattactagagcttatcaaaattttgggaatctgactttctctcatattcaaaatagacaattcatattctgtttttagtatgttttaagtatattaaatttagtgacagattcctttttaaatgaaacttttattaagttgattgagttgacatgtgttcatcaaggaataattattatatatttagaatgatttgacaaaattaataaatatcttttatacttctaaaagcacaaaagctgttaaacctaaaatgtggcagttgaaatatagtgtcaaggaagatgaggactgaaagttttccattgtatttagtgatctggaggtcactggtgacttagatggattgatggggcagaaaccagatcngcatgggttgaagcgtaantagaaggtgaagcaatggaagcaatgagaatagacaactcctttttttttttcttcttttatttttaagatggggtctcactctgtctcccaggctggagtacagtggtgtgatcatagcacatcataacctggaactaattcctgggctcaagcaatcctccaaactcagcctcctcagtaactaggattacagggatgcatcactatgcccagctaattttttttatttttttgtagaaacggagtctccttgtgttgtccaggctggtctcaaatttttgggcacaagccatcctctcgccttggtctcccaaagctctggggttacaggcttgaaatacagtgcctggcctgacaactgtttagagaagtttgactaaatgaaagaaaagagagaatgatacctgggaaagatgtgagagcattatcaaaaaataaatgtaaaaagaattttaaagtttgataaaatttttatatcctattttaaaattttaatttcatcaataagtgtgctttgaatatctttttatgtttattagttatatttattttgaattaccttccataactttaacttattttgctatttgaatggttgtctttactttttaattagtaagctctctctgtatacttaagtaattatgtgttatattttgcatatttttttccagtttgccatttcttttttcctgatattttcttattataatatagaagctttaaatttttatatattcagtttgtccttctttccttccatttctttctctttatggtttctggctttggtgttgtgtccagttcactttatatcacagctgatcaatatataccttcttacagtttttatttcctcccccacagccagtgaaattttttcataatattccttttacttcttttttttcttttaacatattgtggaaatgctatttctcagattaaatagtaaacttagaattataatttttctacgcatcaagtagtgggtaccagacttcatagaggttatgtaggaggaagccacattaggaggacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataacaaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcataaaaaaaaagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcaggaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatcc

SEQ ID NO: 434558 - DNA, 9149 bp, Homo sapiens
  misc_feature (594)..(594): n is a, c, g, or t
  misc_feature (669)..(669): n is a, c, g, or t
  misc_feature (1723)..(1723): n is a, c, g, or t
  misc_feature (3590)..(3590): n is a, c, g, or t
  misc_feature (3609)..(3609): n is a, c, g, or t
taacagaggataatgttaacggaaattgtgtagtcaagagttaaaatctggccaaaataatctgaccagatagttatatagttaggctacattctatcaagaaacataaaggaatagagatattttaaatgttgtgatattccttatttataatccccttcatagtacttttcatactgtactataatataatgtatctgtttacttgtctgtatccccctctaggctgtaagttccttgaagaaagaaagaactctctcccattctctcttatagtagaagttagcatagaggtgcctggcatataggtggccagacacctattcaaaccctgtagaatgaatgcttttacagctagtaaacagaccaaagcccatacccaatatcatatgctgcatattgtcaatagaaatactggaggagcaactgggaagcaggcactcagaaattttttttgagtggtaaagagggtcctgatcttagatgctttcagtcagagctgcagtatacagttggataggttgttcactgcacaaggttaaccagctaagggcactaattggggcagaaaatccagcctgtattctacttganaagccatcaactccaacaccgctctgtatctgcccacaggaagcaatgccttttttcaaattcctacaaaggccntgtacaaacttcagatagtcttgatttaaataatgacagagtaataatgtctgacaggttacatctcaggagcaagaaaaattgccctaccaatctgattccaccagagagtaaaagaaatagtgaagactgtctattcttaaaatgaaaacactgaggttggagatggtttttctctggattctcaacatagggtgatgtgcttacaaaataattttttttaaataaaaaagacccacataagggagcctctgtattcaacttgatcccagaatatgagttacagaatcagagatgcataaaaatctggaagaaaccttaaagttcatagaattccattgctagaaggaactttagatatcatctggtccaagaatcttaattttacagatgaggaaaccaaaaagatcaggaagattatgtgatttgcctgtggatggttagcaaagctaaatctagaacctggttgttttctacctctcaatcgaacactctttaccacagctggttggacttgacatcattataatcaactaagactgattgcgcacccactgtgtgggagaggctgacatggacttggtttccatcaagggcctagcaatgaggttgagaaaacaggaaatccaagcatcaaaagataagtaataatatgagatggcatatgaagcaaggtttagattccagtttcccagtgggagtggtgacaccaaggtgagtgatgggtgtggggtggagtgccctcgtatccacccacctatgcgtcctggttctgtctggaggcaccagggccaggtgacaaaacgtccaggcgaggccgcagtagggcctaaggtcaaaaagagcaatgctgaatcctacatcctggggccctcctaacacgtagcttaaggctctgggctcatgacccacattgtaaggatgagtggggtaaagcctatccacatctgggctgtgaattccagaagcgggggaccgaggcagctgtgcatgaagaccgcaaggaaggaggaagggagccgaggaggcccaagagcggcgggcgacctgacancaccctgccctcccagccagaggggcaggggggaaccccgcgcgcggcgccggtgcagcccgggcttccggggcggcgcacgcggccggggggcggggcgggggccgaagcaccgcctacgtcgggctgcgtgacaatggggccggcggcagaacgcagctgcggcggctgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgactttagctccgccgagtcgggctcctcgctgcgctactacagcgagggtgagagcggcggcggcggcggcggcagctccttgtcgctgcatccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtgggatgaagtatatctttatagtgatgcaacaacatctaaaattgcaagaacagttacccaaaaactggggattttctaaaggtaattgttaaatattactagagcttatcaaaattttgggaatctgactttctctcatattcaaaatagacaattcatattctgtttttagtatgttttaagtatattaaatttagtgacagattcctttttaaatgaaacttttattaagttgattgagttgacatgtgttcatcaaggaataattattatatatttagaatgatttgacaaaattaataaatatcttttatacttctaaaagcacaaaagctgttaaacctaaaatgtggcagttgaaatatagtgtcaaggaagatgaggactgaaagttttccattgtatttagtgatctggaggtcactggtgacttagatggattgatggggcagaaaccagatcngcatgggttgaagcgtaantagaaggtgaagcaatggaagcaatgagaatagacaactcctttttttttttcttcttttatttttaagatggggtctcactctgtctcccaggctggagtacagtggtgtgatcatagcacatcataacctggaactaattcctgggctcaagcaatcctccaaactcagcctcctcagtaactaggattacagggatgcatcactatgcccagctaattttttttatttttttgtagaaacggagtctccttgtgttgtccaggctggtctcaaatttttgggcacaagccatcctctcgccttggtctcccaaagctctggggttacaggcttgaaatacagtgcctggcctgacaactgtttagagaagtttgactaaatgaaagaaaagagagaatgatacctgggaaagatgtgagagcattatcaaaaaataaatgtaaaaagaattttaaagtttgataaaatttttatatcctattttaaaattttaatttcatcaataagtgtgctttgaatatctttttatgtttattagttatatttattttgaattaccttccataactttaacttattttgctatttgaatggttgtctttactttttaattagtaagctctctctgtatacttaagtaattatgtgttatattttgcatatttttttccagtttgccatttcttttttcctgatattttcttattataatatagaagctttaaatttttatatattcagtttgtccttctttccttccatttctttctctttatggtttctggctttggtgttgtgtccagttcactttatatcacagctgatcaatatataccttcttacagtttttatttcctcccccacagccagtgaaattttttcataatattccttttacttcttttttttcttttaacatattgtggaaatgctatttctcagattaaatagtaaacttagaattataatttttctacgcatcaagtagtgggtaccagacttcatagaggttatgtaggaggaagccacattaggaggacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataacaaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcataaaaaaaaagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcaggaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatcc

SEQ ID NO: 434559 - DNA, 362 bp, Homo sapiens
tcgttctttaatctcccacaacttctttttccggaaaatgtaatgcagaataaagataatgccctcggtatggtatatgtcaggaatagcattcagaatactataaaaatgatctacttagagttcttctgcttattgaaaaattggatcagttcttctatgagatcccagcttcagtgttaccattacagactattttatgtgtattttcatcccatattttctagtcttaaatggtagtggttctgaaacctgaaaattgactagccacttaatgtgctaaagtatatttgtgtatacttctacaaagaaggaacctgaagaaaagcataaggtcattttcttccttctttattgtccta

SEQ ID NO: 434560 - DNA, 4827 bp, Homo sapiens
gccattccctgtagcaggattaatcatttataaaataaagtccctatccattacttgcttcacataactttttttatgtgaaatagtgttttattgaattaagttccatatctgagttttttagataacatattgattttaaaatctgagtgttataattcttcaaacaaataaagtttgtcttggagaccttcaaattagcttttcctttttgcaatagctgttcatagtttcaagttgagtcgaaaccatgtggactggcacagtgtgggatgaagtatatctttatagtgatgcaacaacatctaaaattgcaagaacagttacccaaaaactggggattttctaaaggcatcaagtagtgggtaccagacttcatagaggttatgtaggaggaagccacattaggaggacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataacaaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcataaaaaaaaagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcaggaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatcc

SEQ ID NO: 434561 - DNA, 1229 bp, Homo sapiens
gcctggaattgagtattattaactatatatcttttaaaatgtttgattattttgaatcctcaattatctctgctgtgaaaccactgattttggtattcattggagattgacttataagaacaggagtcagctatatgtttcaagcattttattaggcaaataaacagacatttactgcacaacaggacgtgttatcccaagtttatagatgataaaatcaaggcctttgaaacattcatagtgcaatactgtaatgcaattctgacactacccacccagagttcccgcagactccctaagttaagggcatagtacccaacaaaattgcccttgcttcagatgccagcaacaagttggaggccctaggccacctgcacttctgataactggctataagttcaggagtccccacaactacctcaggtttgataattcattaaaatgactcaactcaggaaagtgctctacttatcattaccgttttattattcagggtacaaatcagggccagccaaatgaagggacccgtagggtgaggtctgggagggtcctgaacacagagcattgtgccctgtctccatgggatcagggcacatcaccctcctggcacactgatctattcaccaaccaggaaactccactgagctttggtatccagagattttagcagggcttcattatttaggtttgattgcaggattgaattcaatatccagatcctctttcatccccagaggtcaggaagttgacccaatatcaggtgactcaaaaccctgtctctaatcacatggtggagcctggcatcctaagttattagcattagctatctgaggcccaccatgagtcacctcattagtataaattgtcaaggtccaccgtaaataacagagatattcctgtcacttgggaaattacaagggttttattcttcattatacaacagagggtcatacatctaatgaggactagagtcaggatttaatccagttctgtctgaattcaaagccccagctctatccactattccatttttacaattaagggccttagataagtggtttgtttaaggtcacacagctagtaacttaacaatagagcctggtcccggtacagactaccaatgtgtgctccttccataatgcagttacttccatgatgcatgttggggtgcatttgacttgtttctgtaaattttgcaattgtattatagaacacagcgtcctagctaa

SEQ ID NO: 434562 - DNA, 2861 bp, Homo sapiens
gggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgactggccctctcagcccacgaccgacccacctcaacttctactggtccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtgggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagtttttttttggttttttttttaaggatttcatagttttttttttttttttttggagatgttgcccaaaaaaatggatctgttgcagtggtgcaatctgggctcactgaaaccaccacccaggttcaagcaattatcctgcctcagcctcccgagtaggtgggattataggagcgtgccatcatgcccggctactttttgtatttttagtagagacagggtttcatcatgttggccaggctagtctcaaacccctgaccttaggtggtcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcggctgtgcttgaagtggcatgcctcctctgctgcagggctcccccacccccacacggcctctaaagatgtttatttccttatagactgattaaagtcagccattctttttcctcaagtctgtgct

SEQ ID NO: 434563 - DNA, 2997 bp, Homo sapiens
gggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagaagaggaagctaaggcctgggttgggtaactgcctgacgttttactgctctctgtttcctcgagtcactcccagattagtggtgtctagctcagcactgtttctgttatacttcattcataattcccagcgctgttggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgactggccctctcagcccacgaccgacccacctcaacttctactggtccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtgggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagtttttttttggttttttttttaaggatttcatagttttttttttttttttttggagatgttgcccaaaaaaatggatctgttgcagtggtgcaatctgggctcactgaaaccaccacccaggttcaagcaattatcctgcctcagcctcccgagtaggtgggattataggagcgtgccatcatgcccggctactttttgtatttttagtagagacagggtttcatcatgttggccaggctagtctcaaacccctgaccttaggtggtcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcggctgtgcttgaagtggcatgcctcctctgctgcagggctcccccacccccacacggcctctaaagatgtttatttccttatagactgattaaagtcagccattctttttcctcaagtctgtgct

SEQ ID NO: 434564 - DNA, 2951 bp, Homo sapiens
gggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctaggctctctgtttcctcgagtcactcccagattagtggtgtctagctcagcactgtttctgttatacttcattcataattcccagcgctgttggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgactggccctctcagcccacgaccgacccacctcaacttctactggtccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtgggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagtttttttttggttttttttttaaggatttcatagttttttttttttttttttggagatgttgcccaaaaaaatggatctgttgcagtggtgcaatctgggctcactgaaaccaccacccaggttcaagcaattatcctgcctcagcctcccgagtaggtgggattataggagcgtgccatcatgcccggctactttttgtatttttagtagagacagggtttcatcatgttggccaggctagtctcaaacccctgaccttaggtggtcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcggctgtgcttgaagtggcatgcctcctctgctgcagggctcccccacccccacacggcctctaaagatgtttatttccttatagactgattaaagtcagccattctttttcctcaagtctgtgct

SEQ ID NO: 434565 - DNA, 2679 bp, Homo sapiens
taaaaagaaaaagcttttaattgctccagtactattttgccgtggcttctaactttttagcaaagttagatagcaccaggaatgtggttttaggttgtgttctggcatgttctgtgtttagggacatggggaaaaaggcctgctctcgctcttgctgctctgaggatggggagttgggggggatgtgtgttcccctgttggcttctggccttgtcagctctcctcccactggaagcctcctcaccatccctgtcgggttgcaggtcttccactgccacttcaacagcaacttcttccctctcttcctggagcatctgttgtccgaccatatctccctttccacgggctccatcctgttgggtgagtgtggaccttgggtgcttcatgcaagctggaaggagagagacctgtatttttagtagagatggggtttcaccgtattagccaggatggtctccatttcccgacccagtgatccacctgcctctgcctcccaaagtactgggattacaggtgtgagccactgcgcccagccagggacaatctttttaagacaccaagtgctgccgggtgcagtgggcatggggggcagggtgtggtgggtgttgaggggggcggaggctgtgctggtgtgggtcctcttggagatggtggcaccctgagggggtgcagtggctggttaacacagaggaatatcatctgatgggcctgggtgtgagtcttgactctgtgctcatttggtgggcagcctcaggtgggttagttcatctttttgggcctctctttctcatccgtaaagtggggatgataatagtactcaccttaaggggctgtgaagatgaactaagacagtgaagctcttagcacagagcccagtgcatcgctagtgtacaggaatgcagtcggctgtgaagctgatggcgctcactggcactgcagcagtgcccttgacaaggtggctccccgtcttcctccccaggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagtttttttttggttttttttttaaggatttcatagttttttttttttttttttggagatgttgcccaaaaaaatggatctgttgcagtggtgcaatctgggctcactgaaaccaccacccaggttcaagcaattatcctgcctcagcctcccgagtaggtgggattataggagcgtgccatcatgcccggctactttttgtatttttagtagagacagggtttcatcatgttggccaggctagtctcaaacccctgaccttaggtggtcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcggctgtgcttgaagtggcatgcctcctctgctgcagggctcccccacccccacacggcctctaaagatgtttatttccttatagactgattaaagtcagccattctttttcctcaagtctgtgct

SEQ ID NO: 434566 - DNA, 999 bp, Homo sapiens
gggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagaggctggagtgcaatggcgcaatctcagctcactgcaacctccgccttcgtggttcaagtgattctcctgtctcaacctcatgagtagatgggattacaagcacccgccaccacgcccggctaatttttgtatttttagtagagacggggtttcgccatgttggccaggctggtctcaaactcctgacctcaggtgatccacctgcctcggcctcccaaagtgctggtgtgagccaccagcgcctggccagagtgggttttagcagaggaactgacaccagcaaaggtttgcagacagtgtttctcctctggaacagcctcaatgaccctctcttcggttggctcagtgaccggcagttcctcagctcccagccccggggaagagatctaccctggcttggcttggttggcccctctggactgtggactgcaaacaccctctgctgcttctggaagattcctttgccccatccctgcttgagcccgtcatcacccccaaccttgagaagtgggcatcccataccctttggccatcagcccaacaggctaataagggggtggaaattggggcagaggaggagagtgtacccactgg

SEQ ID NO: 434567 - DNA, 2841 bp, Homo sapiens
acattcttccgtttctggcacttcccttcccgtcttccttatcaataccaacagctctctgtttcctcgagtcactcccagattagtggtgtctagctcagcactgtttctgttatacttcattcataattcccagcgctgttggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgactggccctctcagcccacgaccgacccacctcaacttctactggtccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtgggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagtttttttttggttttttttttaaggatttcatagttttttttttttttttttggagatgttgcccaaaaaaatggatctgttgcagtggtgcaatctgggctcactgaaaccaccacccaggttcaagcaattatcctgcctcagcctcccgagtaggtgggattataggagcgtgccatcatgcccggctactttttgtatttttagtagagacagggtttcatcatgttggccaggctagtctcaaacccctgaccttaggtggtcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcggctgtgcttgaagtggcatgcctcctctgctgcagggctcccccacccccacacggcctctaaagatgtttatttccttatagactgattaaagtcagccattctttttcctcaagtctgtgct

SEQ ID NO: 434568 - DNA, 3480 bp, Homo sapiens
gggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgactggccctctcagcccacgaccgacccacctcaacttctactggtccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtgggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggtgagtgtggaccttgggtgcttcatgcaagctggaaggagagagacctgtatttttagtagagatggggtttcaccgtattagccaggatggtctccatttcccgacccagtgatccacctgcctctgcctcccaaagtactgggattacaggtgtgagccactgcgcccagccagggacaatctttttaagacaccaagtgctgccgggtgcagtgggcatggggggcagggtgtggtgggtgttgaggggggcggaggctgtgctggtgtgggtcctcttggagatggtggcaccctgagggggtgcagtggctggttaacacagaggaatatcatctgatgggcctgggtgtgagtcttgactctgtgctcatttggtgggcagcctcaggtgggttagttcatctttttgggcctctctttctcatccgtaaagtggggatgataatagtactcaccttaaggggctgtgaagatgaactaagacagtgaagctcttagcacagagcccagtgcatcgctagtgtacaggaatgcagtcggctgtgaagctgatggcgctcactggcactgcagcagtgcccttgacaaggtggctccccgtcttcctccccaggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagtttttttttggttttttttttaaggatttcatagttttttttttttttttttggagatgttgcccaaaaaaatggatctgttgcagtggtgcaatctgggctcactgaaaccaccacccaggttcaagcaattatcctgcctcagcctcccgagtaggtgggattataggagcgtgccatcatgcccggctactttttgtatttttagtagagacagggtttcatcatgttggccaggctagtctcaaacccctgaccttaggtggtcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcggctgtgcttgaagtggcatgcctcctctgctgcagggctcccccacccccacacggcctctaaagatgtttatttccttatagactgattaaagtcagccattctttttcctcaagtctgtgct

SEQ ID NO: 434569 - DNA, 1293 bp, Homo sapiens
gggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgactggccctctcagcccacgaccgacccacctcaacttctactggtccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtgggcagtgaggaggcggacagcatcaccttgggccggtatctccggcagctggcacgccatcggaacttcctgtggttcgtgagcatggacctggtgcaggtgcagtggctcacgcctgtaatcccagcacttcgggacgccaaggtggaaagaccgcttgagcccaggagttcgaggctgcaatgagttatgattgcaccactgcactccagcctgggcggcagagaaaggctccatctctaaaaaaagaagagctaagtgctgtacctaaaacatgcagtatataaactggctgaacttagaaataaactgttttcatgttatgaaa

SEQ ID NO: 434570 - DNA, 372 bp, Homo sapiens
tgttatacttcattcataattcccagcgctgttgtaagtacaaactctctcctgttggaaatgagtttttaaatgattcagaggtctggggttaagaacagagctggctctgatccctgttgctcactggttccttcttccccagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggc

SEQ ID NO: 434571 - DNA, 4437 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434572 - DNA, 3918 bp, Homo sapiens
gtatttgcaggacgacccttcgaactcttcatagcagccacaaacattcgctactgctactacaacgagacccacaaggttctgcagttgtatttctttctcttttagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434573 - DNA, 4366 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaaaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434574 - DNA, 4795 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagatggaaaaacacaacaacaaaaaaaaaaaaaaaaaaactgtgttgtggggcgcgcccgcgggcccccggaaaaagatttttaaaaccccttgggtgtgggggcgccgggggccccaatgagtggtgatgacgtgcacacagtggcgccagtacagcgggttcgccataaaggaaaaactccgcggggagaacgaaacaaaggggtggggggttttctccccaaatagtaaaaaaagccggcggggagggacacaacgaagagcgcgtgtcttgtgaacaacacaccagaaggggaggccgcagaacgccaaaacgggggtacaatacacaggggggccaaggaacgccagatataaatcc

SEQ ID NO: 434575 - DNA, 4676 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagatgatcagctgcctgtgagtgttctgaaatccacgcacctggacgtttcttctggtgggtcttggctgcctggtggaatttggaaggtgttggtatcaaggtcaaaggtgggtgcctgaacctgcctttcaaagagggttttcttagaccgtggccagaagcagagtcacatgctcaaatggtcagagctggatgggactgtgcaagttgtccaggcatatcatcctacaggtaaggaagc

SEQ ID NO: 434576 - DNA, 4315 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccatgtacactgcccaagccgaatgtccagcacatgcgccgtactagtgacctagt

SEQ ID NO: 434577 - DNA, 1903 bp, Homo sapiens
gagaggagcacatatttccctcccgcacgtcccgagcaagaggcaggcccagaagagccagcagctcttctctgtgtctgtgacacttttgaggagattgcaggacagtgatctttgcagctgttgtgtgtgaactgaggtgatatgaggaaggtgaaggcgagggctgtttgagaagggcgcctacccccagcctggaaagaaggagaggcctgcggaagcactaagcctttcttctctgagtgtttacccttcatcaatgatgggttattcaaaaaaagggggttcttggtgccagttaaacctctgtgttgcccagaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434578 - DNA, 1581 bp, Homo sapiens
actgaggagtaggggtttgggggagacaatgaggtgattgggggctgccggggatgcctccagacctctaactctgcgtgatggcaccccacagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434579 - DNA, 3716 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagctgtttcatccatttgggaaaagatgttgggaaaggccactttgctcgcaggggtgaggggaaggatagagaatctatttttaataaataacattctagaaagat

SEQ ID NO: 434580 - DNA, 888 bp, Homo sapiens
  misc_feature (44)..(44): n is a, c, g, or t
  misc_feature (61)..(61): n is a, c, g, or t
  misc_feature (80)..(80): n is a, c, g, or t
  misc_feature (87)..(87): n is a, c, g, or t
  misc_feature (94)..(94): n is a, c, g, or t
  misc_feature (98)..(98): n is a, c, g, or t
  misc_feature (105)..(105): n is a, c, g, or t
  misc_feature (107)..(107): n is a, c, g, or t
  misc_feature (114)..(114): n is a, c, g, or t
  misc_feature (137)..(137): n is a, c, g, or t
  misc_feature (139)..(139): n is a, c, g, or t
  misc_feature (164)..(164): n is a, c, g, or t
  misc_feature (214)..(214): n is a, c, g, or t
  misc_feature (242)..(242): n is a, c, g, or t
  misc_feature (250)..(250): n is a, c, g, or t
  misc_feature (255)..(255): n is a, c, g, or t
  misc_feature (262)..(262): n is a, c, g, or t
  misc_feature (271)..(271): n is a, c, g, or t
ttagaggcccaaatcaagaaaccccaaaacagagccaagcaagnttgcaagcaacagcagngcacaaaagcaacaaaaanaagaatntgcaaanctgnaagccgnanagcaaantagctgcaagcacaaaacttcgngncaatctgctgcttgtgcatccatgnggcaagcataactcttcaacttaatctgcaaccccctctactgggcgtgncactgcttaaaaagccaaacgcagcagnccccccgncaacnaccctgncagagcctnccccgccgcaatttcgcccctcctggcgccctgctgctgctctgctgcagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434581 - DNA, 340 bp, Homo sapiens
gaaggttctctagaagcaatgcaggggagtcactgtggcttagactgagagcagctctcttccctcggcctcttccccttcacgtttgctcctagatgggctatggcagccgtgctctgcagctgctgcagatgtactatgaaggcaggtttccttgtctggaggaaaaggtccttgagacaccacaggaaattcacaccgtaagcagcgaggtaagcatctttcgacagacctcctgtgtcctggttcttgggaggataattctctgggtttttaggggcatcaacaaaaaccagtccagagctttggacccctctctcattttcttctgctgctttct

SEQ ID NO: 434582 - DNA, 3394 bp, Homo sapiens
gcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacacccagctaccgcgagcagtgggactaaaatgcgcaaccgcagtggacatctaggcctcagctccgcttctggtggcttacgtcattactcagcgacagccttgaggaaggtcccttctcgctcgccatctctgcgactttaatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagat

SEQ ID NO: 434583 - DNA, 3879 bp, Homo sapiens
  misc_feature (3877)..(3878): n is a, c, g, or t
actgacagacttcagaatttattagggtttgtaatttccaggttccaaagcgcagcaagggaaagggcctggctgggtagtacgttacacccggaagtaaagagacgcatacaccgttgggtgcactttatagtctggctggcaaacaagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434584 - DNA, 3416 bp, Homo sapiens
  misc_feature (3414)..(3415): n is a, c, g, or t
gggggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434585 - DNA, 1019 bp, Homo sapiens
gggggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggtaagagatgggtaaaagaggaaacacccttttttcatcatttagatggaaggatttcaagataaggagaattggtattctttttccttgcttctctttatgaaaatatagtatattgtttttgtgagtttaagaactttttagtataataaagtagaaaatcactggcttctgtattttataaggtgaaaataggggacatggagcactattatacaaatgccaaactaagaaacaggttaatgtacataatggtgttaagtatttacatatatggtcctatttgtaatttttatacaaataaaatatgacttaaaacccaatttgaactcatttggggtattataatttatttattcagctgaattaatagctccccccaaagcccaatgtgttccataaagtttttacaaatgaactaatggaaatttgtatgtttatatattgtgtgtttgtatattgatgacccatataatgaagtatttgggataaaattcaagtaaatatttgaagttttctctataaatgctccc

SEQ ID NO: 434586 - DNA, 4100 bp, Homo sapiens
  misc_feature (4098)..(4099): n is a, c, g, or t
actgacagacttcagaatttattagggtttgtaatttccaggttccaaagcgcagcaagggaaagggcctggctgggtagtacgttacacccggaagtaaagagacgcatacaccgttgggtgcactttatagtctggctggcaaacaagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagaggtgggctcgagggaaagatctgggtcccaccactacttcctggagacgccggggaaagcaggccatccttcgagccacccatctcttctccgattggttaactgccttcttattgcgctccgctggctggtgattggttgggatgcaccgtctatcacctgcttccttgtgagaatctaggtctctaagggaagcgttacttgaggctcggttgggaagagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434587 - DNA, 4047 bp, Homo sapiens
  misc_feature (4045)..(4046): n is a, c, g, or t
actgacagacttcagaatttattagggtttgtaatttccaggttccaaagcgcagcaagggaaagggcctggctgggtagtacgttacacccggaagtaaagagacgcatacaccgttgggtgcactttatagtctggctggcaaacaagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagaggtgggctcgagggaaagatctgggtcccaccactacttcctggagacgccggggaaagcaggccatccttcgagccacccatctcttctccgattggttaactgccttcttattgcgctccgctggctggtgattggttgggatgcaccgtctatcacctgcttccttatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434588 - DNA, 1618 bp, Homo sapiens
  misc_feature (1616)..(1617): n is a, c, g, or t
gccagcacagggaaggttcctgttgttatctgtacctaagttactcagttctgagtgcatgtctggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434589 - DNA, 1482 bp, Homo sapiens
actgacagacttcagaatttattagggtttgtaatttccaggttccaaagcgcagcaagggaaagggcctggctgggtagtacgttacacccggaagtaaagagacgcatacaccgttgggtgcactttatagtctggctggcaaacaagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggtaagagatgggtaaaagaggaaacacccttttttcatcatttagatggaaggatttcaagataaggagaattggtattctttttccttgcttctctttatgaaaatatagtatattgtttttgtgagtttaagaactttttagtataataaagtagaaaatcactggcttctgtattttataaggtgaaaataggggacatggagcactattatacaaatgccaaactaagaaacaggttaatgtacataatggtgttaagtatttacatatatggtcctatttgtaatttttatacaaataaaatatgacttaaaacccaatttgaactcatttggggtattataatttatttattcagctgaattaatagctccccccaaagcccaatgtgttccataaagtttttacaaatgaactaatggaaatttgtatgtttatatattgtgtgtttgtatattgatgacccatataatgaagtatttgggataaaattcaagtaaatatttgaagttttctctataaatgctccc

SEQ ID NO: 434590 - DNA, 1512 bp, Homo sapiens
  misc_feature (1502)..(1504): n is a, c, g, or t
  misc_feature (1508)..(1511): n is a, c, g, or t
actgacagacttcagaatttattagggtttgtaatttccaggttccaaagcgcagcaagggaaagggcctggctgggtagtacgttacacccggaagtaaagagacgcatacaccgttgggtgcactttatagtctggctggcaaacaagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgctttgccagatacaagctgaagtgctaccagaaaaccagttgttaagtctatctggaaaaatagactgtgaagcacctcatcttcatttcaatagcttcgctggaacctggagcctaaggggtaaaatgtattatctttctcttcacaaacagttttttttcttttatggaacatagaatatgacaacatttgttttgtcaactgattacattttaaaacattgtacttgttcatattgtacttggctttgaaataccctgaagcatctatggaattgtaatttattgtaatgcaataagcatttatgtaattaaaaaaagcattcttaaatatgannnaaannnna

SEQ ID NO: 434591 - DNA, 3861 bp, Homo sapiens
  misc_feature (3859)..(3860): n is a, c, g, or t
actgacagacttcagaatttattagggtttgtaatttccaggttccaaagcgcagcaagggaaagggcctggctgggtagtacgttacacccggaagtaaagagacgcatacaccgttgggtgcactttatagtctggctggcaaacaagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctgaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434592 - DNA, 2868 bp, Homo sapiens
  misc_feature (21)..(21): n is a, c, g, or t
  misc_feature (39)..(39): n is a, c, g, or t
  misc_feature (42)..(42): n is a, c, g, or t
  misc_feature (2866)..(2867): n is a, c, g, or t
caaggtccctgtcgaggctgnatgagccaaaactgtgcnagnactacagcctaggcaactggagcgagactcgtctcaaaaaaacaacttcaggctgggcacggtggctcacacctgtaatctcagcactttgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaanna

SEQ ID NO: 434593 - DNA, 1063 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaacccc

SEQ ID NO: 434594 - DNA, 834 bp, Homo sapiens
  misc_feature (827)..(827): n is a, c, g, or t
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgaatgaaacctgtcagctttctgtttaaataaaaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaacaccatggcggtattcaacaggctcttgaaggaaatcgggcaaattagtactgaaaagtgtaggtctcacgggttacggttgccacagccccgcattgagaccgaaccgtccggtctagctcgctgcgggtcctttctttctcctgttgttgtcagcactgtgtttctctctgccgctgcccactatacatgtcnaaagaga

SEQ ID NO: 434595 - DNA, 3266 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434596 - DNA, 3465 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaataaactcctgtagcctatgatgaatatttcagaaccaagaggaatacccttgggtgacatatttatgggcagctttcctctttatgccttgccaactcatctgcttgactaagccttcctcatccagctaaaactaggaaaactactgcagacacagatgccccttggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcaactacataggcccagaagagatccacagtaatgtttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434597 - DNA, 3301 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgaatgaaacctgtcagctttctgtttaaataaaaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434598 - DNA, 3441 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgtgagtttttaaatatatattttaactaaatttataaggaaattttaactacgaatgaattattatctgctattaaatttggggaaaataattcactattactcataagtaattcctgttacattctctatttccatcaggaatgaaacctgtcagctttctgtttaaataaaaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434599 - DNA, 3206 bp, Homo sapiens
cgcagtgtggtaccccacctgtcattgcgcgcctgtgagtcacacgtccgatcgacgtccaagtccgctggtccacaatccaggtgctcgccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434600 - DNA, 3488 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaataagaggaatgagacaagtggaacaaagctacaactttaaaatgcataacccactccttggttctgctgcttggttgtacattacagttctgtctggccagttgcccacattaaaagccaaacaaatgtgcttctttttttatatttagctttgactttacgtttaaaatttatgcattgtgtttaattaccttttccgtgttgtattttctttctcttttaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434601 - DNA, 3212 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacattggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434602 - DNA, 2995 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagagggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434603 - DNA, 3122 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgaatgaaacctgtcagctttctgtttaaataaaaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctatttttta

SEQ ID NO: 434604 - DNA, 1486 bp, Homo sapiens
ccgtgttaatgtgaccttgatctgttctcacaaaacgcgggcatcaatctccaaattatctaaactgctttgggaaggcttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtactttt

SEQ ID NO: 434605 - DNA, 372 bp, Homo sapiens
tcacaaaatttttaattaagtttgtagttatttctaagtttgaagaccctcaattattcagaattttaacaggatactttctttttccttggttagcaattattttgaaaatagaaaatgtgtaaatattaagaaccttttttttccctctcccaggggcttctttcctgtcgttgttggctttattagaagagtgccagtccttggatccctcctaaatttacctggaattagatcagtaagtaatcatgtatattttaggccaacaaaatacgtattttgatgctttttacttctagaaatttgagtaattgatacttggttaattgctgagttttgtattatgatatagttacttcacatagatcatga

SEQ ID NO: 434606 - DNA, 3014 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtactttt

SEQ ID NO: 434607 - DNA, 827 bp, Homo sapiens
  misc_feature (821)..(821): n is a, c, g, or t
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacatacctacaaagtaccagcgcaattagcaagaagcatgaaacggtctctcagtgaccggagagtccagcactggaagggcaccgtagcgctctccaggtgggtgttcccatggcccccctccggggttcttagggcgccctctatcgcgggtctctttgttttttacttcttatctcttcntcgccc

SEQ ID NO: 434608 - DNA, 3116 bp, Homo sapiens
aagcgctcttaaagcggagtgagggtggctgcgtgtttccggaagacgtggcggctctcgcctgggctgtttcccggcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaaatctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttttaaaaaaaacaggggggggcaaaatctgagggcaagttggtccgtttgtaaggcctaaggggttaaaggggggtaaggggagaggggttggaccttgggga

SEQ ID NO: 434609 - DNA, 3906 bp, Homo sapiens
actcgctccctcccccggatcccgactgggaagggggcggaggggacgacgtccgcgagaatgcaaaccacacaaaaccccgaagtggccgtccccgccgggctcgaacctctgcgaacacccgctgggctgctgctcccccttctttctgtctttcctttattttttggaagtgacaagggcccatctgcgcccagacccccgttcgccctctggcccgcgggcgaagaggggagagggagctgcccgcgcagtccccgggctcgggccattcgaccgggtggggggtgacggggggtcgcggaggcggccaggctaggaaaggggagaagagccgaagacagcacagacttgagcggcggcgccgcgggaggcactagagcgggcccgagcgaaacataaacaaacgcacgcacacccgagctcgggctctgaccgcggctcggctgcgccagctccggccgctgcccgctttaaaggcgcggccgcccctcccccgggcgcccctcccccttctccccgccccgccgcctagcccgggagggacctgcggctgggcggcggggggagggggctgccccgcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaagga

SEQ ID NO: 434610 - DNA, 4284 bp, Homo sapiens
actcgctccctcccccggatcccgactgggaagggggcggaggggacgacgtccgcgagaatgcaaaccacacaaaaccccgaagtggccgtccccgccgggctcgaacctctgcgaacacccgctgggctgctgctcccccttctttctgtctttcctttattttttggaagtgacaagggcccatctgcgcccagacccccgttcgccctctggcccgcgggcgaagaggggagagggagctgcccgcgcagtccccgggctcgggccattcgaccgggtggggggtgacggggggtcgcggaggcggccaggctaggaaaggggagaagagccgaagacagcacagacttgagcggcggcgccgcgggaggcactagagcgggcccgagcgaaacataaacaaacgcacgcacacccgagctcgggctctgaccgcggctcggctgcgccagctccggccgctgcccgctttaaaggcgcggccgcccctcccccgggcgcccctcccccttctccccgccccgccgcctagcccgggagggacctgcggctgggcggcggggggagggggctgccccgcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgtttggcttggcagaacaaatgaccttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaattataagcttaggttgtaattgtacaagtgactcaatggaagtacaaaatagggcagttttaacttttttttctgcttctatggatttcattttgttgtgttttcaaaaagttatggtgctgtataggtgctttctgttt

SEQ ID NO: 434611 - DNA, 3287 bp, Homo sapiens
ggggaggaggaggaatgtggaaggtggcggcgcgcgagctgacaggcggttcctcgggcgggctgcggcgacggcccgagcgcttctccttcgccgaggttgcgcgccccctcctcgccgtgccccgggcccgcgcgggatcgtgcgtcgtcccgccgcgtccctgaagggaaggaagcgaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaagga

SEQ ID NO: 434612 - DNA, 2926 bp, Homo sapiens
tagcctcagtagtactatagtgagaggtaaaagacaagaatcttaccttatttcatacagctggagcaaaaagggacataagattagcttccaaacttatgttatgcctttaaatgaaaacagaagtagcgtggctttttctgttacttagaaactttttctcttgggacatcataaagagaacactgatctaataaacgacattctcctgcttgaaacttggttctctgaggtaatgagccagtccattagtttcagtgtaccttcctcagtgatgtatctatgttcatctatctggccttgtgaatatttttttgacgtaacatgagctagactgagtatgaatggctccaaacttaggagtgactaggatttacagatgaagcagtatggatcagtttctttgggaaggttcttggaggaccctatgggaggaaaccctggacagaacgcattccctgggatgaaaaaccctgctcaagcctgggtacagtgacccaaggtgacagcaatgacagtggcccttcagaaaggagcaagtggaggtggaccctgcctcaaacagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaagga

SEQ ID NO: 434613 - DNA, 1852 bp, Homo sapiens
ggggaggaggaggaatgtggaaggtggcggcgcgcgagctgacaggcggttcctcgggcgggctgcggcgacggcccgagcgcttctccttcgccgaggttgcgcgccccctcctcgccgtgccccgggcccgcgcgggatcgtgcgtcgtcccgccgcgtccctgaagggaaggaagcgaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaagga

SEQ ID NO: 434614 - DNA, 728 bp, Homo sapiens
gcttagtaattacttactctttttatggtggggaataggggagtcaagattacccacacccagcactgcagacttattaaggcctttatagaaagtggccatttcatctccactggtgttggggtattcgtggaaaagggtggtaagcaattcagttagtccacatagccagtagggaagaaccagaaaagtataactcatctacttaggatgagcggctctccttgttttagcatggaaagtcccatgtcctaggaaatccctcagtccggaagtctagaacagaatcttatctgcaccttgaacatctaactaaaaaggacccaccaaaacacccctaatatggctttctttatctcccaaagtgaatgatcccattccctttgggcttttcaacttcagagcattttgtaataaggacaacatgagaaataaggtaagtaatctttgtgctttgtccttaggatttcagacctttgaaactggtgtagcagagcagctttgctgtgctagccctgggctctgaggtgggtgagggagatggaaggccttgacaggtggccctcaggtgcccactattgctgttgcagtgcccttaatgatctctggttttcttttctcctcctttagaccctcaaactgacacaagacctacagagaaaaccctttgccaaatctgctctcagcaagtggacagtgataccgtttacagcttaacacctttgtga

SEQ ID NO: 434615 - DNA, 610 bp, Homo sapiens
acggaggatgtaatgatcgtgcctatgagtgggcgccacacaggaccccgcggccccccatggccctcggaaccgaggaattaggggcaccctgggttgctcgtcggaagggaaaccgaattgttagaatcccagtgtctccgcgagccaaaggaccgaacgccttcggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttctaatgctttgtgcaaataattatgcgtcca

SEQ ID NO: 434616 - DNA, 237 bp, Homo sapiens
catttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggtagctccgggctgcttctgtaaaccggggagcgggctccatgcacccctttcccgtgtgtgtgggtttcgaggcgg

SEQ ID NO: 434617 - DNA, 5687 bp, Homo sapiens
catttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcaatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatacacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgtgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtatttt

SEQ ID NO: 434618 - DNA, 5718 bp, Homo sapiens
catttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcaatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatacacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgtgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttctaatgctttgtgcaaataattatgcgtcca

SEQ ID NO: 434619 - DNA, 5850 bp, Homo sapiens
aaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcaatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatacacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgtgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtatttt

SEQ ID NO: 434620 - DNA, 5795 bp, Homo sapiens
ggcgtgaacccgggaggcggagcttgcagtgagctgagatcgtaccactgtactccagcctggttagagtttatatttcctttaaatttctagagaaaacagattgtcatgtatttttatagagacaaaatactgatgaaggtgatatacaggtagcttaattatgatttttctaagatttaattagatggtaaatttacagtaattattaatatgttcactgcttttattaaaaaccatcaattctgaatccacaatgacacaaatggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcaatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatacacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgtgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtatttt

SEQ ID NO: 434621 - DNA, 2552 bp, Homo sapiens
aaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactgggtcaataacgactggagtgtgatggagaggaagagacagtacacggttgaaatttttcctgatgaaagctgtgtggttcctaagaattcaagactatccagaactataggatggtgtttataggacacaacagctgacttgaatggactcccactggctaaagatgacacactttgaccgtcagtaagaatgataatttaaatgcatttcaatacatcaagtttgataaaagacacgagttcccaatgatgttaaagatatgcacattgattgtctttagaaaatagttgggaatcatttcattactttgtgaactgaaaaaa

SEQ ID NO: 434622 - DNA, 698 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434623 - DNA, 754 bp, Homo sapiens
  misc_feature (30)..(30): n is a, c, g, or t
  misc_feature (215)..(215): n is a, c, g, or t
  misc_feature (251)..(251): n is a, c, g, or t
gacacttcattgcgaagttctctccctctnacagtctttaaattcagttatttattttatgttaggttccaagttattaagtctgcctgtaactagttttgaaacattcaaaatattattcttgactgtttcctgtggggaagtaaggtggggaaggggcaagaccctaagaaattaagataaagctgctcagctaagttttataaaatctgacntgagtgttttctcttcatatgctgtgcttgtgtaancagtgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434624 - DNA, 448 bp, Homo sapiens
caatataatcctatttgacatttatttgtcttgtttttgcttttattttattacttctctgtttcctgattctgtcttgtgccttctcccgcaaaaacctgccttagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434625 - DNA, 490 bp, Homo sapiens
tttttcaatattgtagacagttgtcattttaagcttttttctttcctttattagtacaaattcaggtagtaaaatattttagtaattcatattattaagtaccaattttctgaatactactttgagcattacacaaagcatgatgtggcgtgccatttactctgagttctactttactattcatttgtatttctatctcttatctgcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434626 - DNA, 1031 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434627 - DNA, 1221 bp, Homo sapiens
  misc_feature (1179)..(1180): n is a, c, g, or t
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttcctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagtctgnngttaacacctgcttaaaattctccttttgcatgttttgtaa

SEQ ID NO: 434628 - DNA, 1250 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434629 - DNA, 1440 bp, Homo sapiens
  misc_feature (1398)..(1399): n is a, c, g, or t
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttcctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagtctgnngttaacacctgcttaaaattctccttttgcatgttttgtaa

SEQ ID NO: 434630 - DNA, 1324 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434631 - DNA, 917 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434632 - DNA, 844 bp, Homo sapiens
tagctatatgttaactagcgataatagacctgtatttactgtatttaaatgagtaaaggaacaagcagtgacacatcactaggaagtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434633 - DNA, 1107 bp, Homo sapiens
  misc_feature (1065)..(1066): n is a, c, g, or t
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttcctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagtctgnngttaacacctgcttaaaattctccttttgcatgttttgtaa

SEQ ID NO: 434634 - DNA, 1136 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434635 - DNA, 1168 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctggcacagatcagattctgccccaagaaataaaatttcaaggttccaggcaccgatttctgcaccggagtacactagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434636 - DNA, 1210 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434637 - DNA, 917 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434638 - DNA, 1088 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctggcacagatcagattctgccccaagaaataaaatttcaaggttccaggcaccgatttctgcaccggagtacactccagcagatcttggatgtgctggatgaaaatcgcagacctgtgttgcgtggtgggtctgctgccgccacttctaatcctcatcatgacaacgtcagggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434639 - DNA, 977 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctgctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434640 - DNA, 1065 bp, Homo sapiens
cctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctagacctgtgttgcgtggtgggtctgctgccgccacttctaatcctcatcatgacaacgtcaggtatggcatttcaaatatagatacaaccctttgaagaacgtcgatgaccgactgggggatgcgagtcctaagaagaaggtatcaactaaatagacgtttcacttctgggaagggcacagcacgtgtaaaaaaggggggttccaaggggctggggaaaaaggcggtgggaaaggaaaaagcaaaaagtgtgggggaaaaagagattttgtggttggtgttaaccccaggtttaggggaatagaaataatctcg

SEQ ID NO: 434641 - DNA, 351 bp, Homo sapiens
  misc_feature (52)..(52): n is a, c, g, or t
ccgcgatagtatcttcacctattttcatttcctcaactacccacacaccacncatcacttgagtgatggccgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 434642 - DNA, 5794 bp, Homo sapiens
gtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacgacagcccatgtactctcgtgaacatggtgctgctgcatctgagcgacttcagttggggacaccgcctcctctgttggcagctcgtttggtgccacctcgaaacctcatgggatcctccattggataccatacctcagtctccagccctacccctctggttccagatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434643 - DNA, 5629 bp, Homo sapiens
gtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434644 - DNA, 5526 bp, Homo sapiens
gactcttttatttgctttctcaacaagtcatagtatcatagtgtaaaaagtagagagtacatctgcctctaccttggggatatgtgatgcttaacagagtaacactgagactttggattccttggagaaaaccactttgtaaatgagattggtgggtttttcagggacatgttttgttgttttctgaactctaagtagatgataataagattctttttttattctttattccacagaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434645 - DNA, 5362 bp, Homo sapiens
tttcagtttcaaaaggtgtgtctagatactgtaacacaaagagaaatacagtcatcccttcacctcaggttccacatctgcagattcaaccaactacagatcaaaaatattcaggaaaaaaataaaaataaaaaaaaaccagtacaataattaaaaggaatgcaagttttaaaaacaatatccataacagctatttacgtagcatttatattatgtattataattaacctagagatgttttagagtatacaagaggatttacctaggttatatgcaaataccaccaccctgttttatatcaaagtcttgaacatttgtgcatttttatatctgcgggagggtcctggaaccagtccctcacagatactgagaggtgactgtaggttgatgtatttgttggagaatatatgttttttaagcagttgtttattttataacaatgagagatggtttaacctctctctgatttgttgtgtgttttgttgctttgttttccctcagatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434646 - DNA, 5332 bp, Homo sapiens
gtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434647 - DNA, 4499 bp, Homo sapiens
ggaaaacattcattacatagcagtgggtcataatttatttaactattttctgtttttgggaatttatattgttttattttcttcaaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434648 - DNA, 4167 bp, Homo sapiens
  misc_feature (15)..(15): n is a, c, g, or t
agtgctgtggtatgncatcatcttctgatacctccgtgcactgttgaaggagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaagaaaaaagatg

SEQ ID NO: 434649 - DNA, 4072 bp, Homo sapiens
gtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagaccgtcgggggatcgtctagag

SEQ ID NO: 434650 - DNA, 3462 bp, Homo sapiens
gtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaatggagttttgctcttgttgcccaggctggagtgcaatggtgcgatctcggctcactgcaacctctgcctccctggttcaagtgattctcctgcctcagcctcccaagcagctgagattacaggagcgcgaagatgatggccatgaactccaagcagcctttcggcatgcacccggtgctgcaagaacccaaattctccagtctgcactctggctccgaggccatgcgccgagtctgtctcccagccccgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactga

SEQ ID NO: 434651 - DNA, 672 bp, Homo sapiens
caaggtaccatctatatccactgagactgaagaagaagaagtcaaggaggaggtaaatttagtggttggaaataagagttgaattagatcacttctcaattatgtattttttatgatattaaatagtataaattaaaaaatgctgggtttttctttcatgcatgcaaattaagacccgtttagatgtttattagagaattaaaacaggtctagagatataagaagctgtgttaggggttattttcttctgatataggaaagactgttcttttttgtttacatttatattggatttatttgagctctagaaatttttattctgatgaataaagtcagagattacataaatgaattaaactttaattggttggtttcactttttgtttattcaagttccatagtaatagatttgagtttcttattttccttctgtgtacaattggttaaaatcagagtgtgcagaagttgaacatagaggagagaattggaaaactaaagacctaaataataaaagtactgaataatcagcttcttaaaatatatgagaatttattttgcttttttactcctgttgtttatcattagtttatttagtgaacacttaggctatattgcgaggttttcctgatttatatgacaatcttggttttaaaagatacctagctagcattt

SEQ ID NO: 434652 - DNA, 478 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccggcgtcaggcacatcattgaagtagatcctgacactaaggaaatgctgaagcttttggacttcgggagtctgtccaatgcttcaaggtttactcagctgtacgaagatgggatgaagtttcaagaagggctcgtcggtggacctgtttgaattgtttctgtagtggctgtattattttcgaataaatctgggacaacagcat

SEQ ID NO: 434653 - DNA, 2376 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434654 - DNA, 2123 bp, Homo sapiens
  misc_feature (1681)..(1681): n is a, c, g, or t
  misc_feature (1726)..(1726): n is a, c, g, or t
  misc_feature (1736)..(1736): n is a, c, g, or t
  misc_feature (1743)..(1745): n is a, c, g, or t
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaaaaaaaaaaaaaaaaaaaaaaaaanaaaaaaaaaaaaaaaaaaaaaaaaaaaaaaaaaaaaaaccttttnaggccacctngccccannnccttttagatctcaccaagtttttcactggcggcgcgaatttcgggcccactggcccaattccccctatggggggggggtttacaattaaggggccggcggtaaaaacgtggggatgggaaaaaccttgggttaccaaacttatggctttggaaaaatccccttttcccagttgggggaataaccaaggggcccgaacggaggcccttccaaacatttcccctcccaaagggaaaggaaattttaaggctttaattttggtaaaatccggttaaattttggtaaccaatcttttttaaccaaaaggccaaatcgggaaaacccctttatataaaaaataacccccataggttgggggtgttccatttgagacaccctt

SEQ ID NO: 434655 - DNA, 1782 bp, Homo sapiens
  misc_feature (36)..(36): n is a, c, g, or t
taagggcctggggttaacccccccctcccgggttancgggctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434656 - DNA, 2208 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434657 - DNA, 2306 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434658 - DNA, 2351 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcggtcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434659 - DNA, 2332 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccactcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434660 - DNA, 2337 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434661 - DNA, 1252 bp, Homo sapiens
agttggggagggcgctcaggcttgggactcctctggggacaaggctcaggaccttggggagggagtgttcgctgggaaaccttgagagattccgtgtcttagaatgctggagagagggtgcatgcttaggacccgtcggggagccgtggctacagagggtctccctcgatgacgacgacgacgacgccaccaccccagcccccgtctgtgactgaaggcccggtgggaaaagaccacgatcctccttgaccgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccct

SEQ ID NO: 434662 - DNA, 1297 bp, Homo sapiens
cgcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgggcggcacgcacgagccaggagcgcaggcggggggacgcgggaggagaggtcggattcccagcgcgcgccagaaaatgaatttaggacctcccttggggcgtggctcagggggatctggcaggtggtgcacgcttaggactccccaggaggcgtggctcgggaggttggttgggggggcacacaggaacactccctaaggaagtgtgatccgagaggttggggtgggggcttgcacgcttaggacgaggggggcctccggaggttgggaagagcacttagaaaacctcctggaggcgtggctagggagacagtctca

SEQ ID NO: 434663 - DNA, 333 bp, Homo sapiens
ccacggggatcgcggacttagggtggtaaaaggcaagcagcgccccccgagccccgccgcccgctcacgcccattgccctgtcgcccgcagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcc

SEQ ID NO: 434664 - DNA, 300 bp, Homo sapiens
aagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccg

SEQ ID NO: 434665 - DNA, 1797 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatata

SEQ ID NO: 434666 - DNA, 1147 bp, Homo sapiens
agtcctttccccctcccgtcctgtccccatcagtgttgaaatgtatgctacagttattatggttgtaatttgttatgccatgttgatcttcttgtgcttttcatatcagaacaatgtatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaagcaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgtttttttaagaaattttaaaaaaacttaatctgccagcttttctctattggaatttgcgaacaacttgtaaaattggaattacagaatattagaatagtcagttatggaaagtcacttcattatccttgtgtcactaaataacgtataaagttaaatcagaagtgtattcatctctgaatttctaatcagttgtttttagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434667 - DNA, 1077 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcataaaaaaaaccctttttggcccccttggccaataattt

SEQ ID NO: 434668 - DNA, 1262 bp, Homo sapiens
  misc_feature (1217)..(1218): n is a, c, g, or t
  misc_feature (1223)..(1223): n is a, c, g, or t
  misc_feature (1229)..(1229): n is a, c, g, or t
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttgggttgatgctgaattagggagtgatatttaccttgatggtatcataactattgtggattcaaaatatggattaaaagtgaaataccactaaaggcagaagagaatgaaatcatcccaccactgacccgttcccaatctgagcatatggatagggcccaaagcacatttaacagaagagaaacctgatggccttatcaatgaagctactagagcanntgttnggaganatcatctcctataaaacgagttggtccaaaaag

SEQ ID NO: 434669 - DNA, 1300 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccaccactgacccgttcccaatctgagcatatggatagggcccaaagcacatttgaagaagagaaactgatggcttatcaatgaagctactagggaggtgatagggagatatcatctcattagaaaagggtggtccggaagagtgtacatattggaggcactttgttttagggatgaaatggtgaaccaggaaaaatggccgtaaggcaaaagttgctggaagtgttggaatgcaaaaaaggg

SEQ ID NO: 434670 - DNA, 1304 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcatccaaaaaaaaaaaaaaaaaaaaaaaattttggggcgggggccggaaagttttaaaaccattggtggggcggggcatgggtaggaatggcaaggtcaaggaaacgggcggagggggttcccaaaaaccgggggggggttgaaaccgggtggggggcagggcgggcga

SEQ ID NO: 434671 - DNA, 522 bp, Homo sapiens
caaagtgaaaaatatatttgaaagggatatcatgtgccacttaaacagattaaccattcaggtcctcttttaaaactaaataagcttgtggtcaatgtttcatctttgtcacattacaacgttcgtaaaagcttgttaggacttttgttcttcttcaattttagaaaagtggttaatccaaggaccaatgtgactttgatgtactgacctggaaagttaaagatggaatcactcaattactattctttttgtaaatttttaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434672 - DNA, 2246 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 434673 - DNA, 1737 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434674 - DNA, 1775 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaaccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434675 - DNA, 2100 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 434676 - DNA, 1894 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434677 - DNA, 1597 bp, Homo sapiens
agtcctttccccctcccgtcctgtccccatcagtgttgaaatgtatgctacagttattatggttgtaatttgttatgccatgttgatcttcttgtgcttttcatatcagaacaatgtatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaagcaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgtttttttaagaaattttaaaaaaacttaatctgccagcttttctctattggaatttgcgaacaacttgtaaaattggaattacagaatattagaatagtcagttatggaaagtcacttcattatccttgtgtcactaaataacgtataaagttaaatcagaagtgtattcatctctgaatttctaatcagttgtttttagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 434678 - DNA, 1895 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatata

SEQ ID NO: 434679 - DNA, 927 bp, Homo sapiens
aggaagaagtaaggaaaagagcaatatggatgtttaaaaatgagaagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 434680 - DNA, 1524 bp, Homo sapiens
ggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatata

SEQ ID NO: 434681 - DNA, 972 bp, Homo sapiens
caaagtgaaaaatatatttgaaagggatatcatgtgccacttaaacagattaaccattcaggtcctcttttaaaactaaataagcttgtggtcaatgtttcatctttgtcacattacaacgttcgtaaaagcttgttaggacttttgttcttcttcaattttagaaaagtggttaatccaaggaccaatgtgactttgatgtactgacctggaaagttaaagatggaatcactcaattactattctttttgtaaatttttaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 434682 - DNA, 521 bp, Homo sapiens
aatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgttttggtattctccagggacaatggccttagagctattgagaatttgatgcaaaagaaggggaaatttgatgacatactgttagagaccactggattagcagaccctggtaagaagtgagattattaataaccagaatatagttctgtgatatattgtaaatagatgtattagaggaatatctaaaatgagtattaaagcttttgttagtattaaaccaaaaactttttttggtttaaaaga

SEQ ID NO: 434683 - DNA, 621 bp, Homo sapiens
cttggagtaatttgatcgtctgaagccttcttctctcagctcgtcaaagtcattctccgtccagctttgttccgttgctggtgaggagctgcgtttctttggaggaggagaggcgctgcgttcctttggaggaggagagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434684 - DNA, 1417 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccaccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcattaacagaagagaagactgaatgggctctctcaatggaagctactagatccattactggactcggaccaatctagaaacacaagatccaggtcaggcagcgatagaatcagcacacggagcaggacttcgaggccacagttgcagctagtccaccagctctctcgacaa

SEQ ID NO: 434685 - DNA, 1796 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434686 - DNA, 2198 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaggcctcgttggcctcagcggtggagctctcaggcg

SEQ ID NO: 434687 - DNA, 1824 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccaccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 434688 - DNA, 1998 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 434689 - DNA, 1641 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaaggtactttaaaaaagctattcctattaataacaaatcattttagttattaataataaacattaagtaattgacaaatatgcttgattctgatataagaaagatctaagtgcatttaaaaagatttggatccaaaatgttgtttggaatgctcttaataagttagtttggcatatttgactagtacatttgcctgtcttcaaaactaagattacaaagccatgataacactgtgtaagtgtttgcttaatgaggaagaaaagacttccaaacactcgagagggtaactcagtacagaaatctgaagtatattgaggaatcttaatttgaagtgtttaaatggctttttaatatttaaaaagccttcttagtgttttatagttgcca

SEQ ID NO: 434690 - DNA, 7003 bp, Homo sapiens
gaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 434691 - DNA, 6949 bp, Homo sapiens
gaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 434692 - DNA, 6483 bp, Homo sapiens
gaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatcccttcgacaccagcatgtcctaactgcccaatgttttccagtacttattcgtgccgtgaccctcctgtaacagccagattgcggtcgcaatacccgggggtaacaatggcccggggggccaacacaccacggcttacaccagaacccggctccaggagtcgcgacgcgctcccgcatatctatacacccaccaagtccccgccgg

SEQ ID NO: 434693 - DNA, 6994 bp, Homo sapiens
gagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgcgccccgcccggtcgcccctcccacacgcccggctcccccacagagacctcctccgccttcaggggctaggagtcctgcacccactagaaaggaatttggagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 434694 - DNA, 7027 bp, Homo sapiens
gaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 434695 - DNA, 7658 bp, Homo sapiens
gagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggtgacaaccttttatttccatttctgctagatgtaaaattcttcactctattttaaaatgttttgcatgttttccaatctctagcttctggattttactgttttttctatcattattgctatttcttagcttttctctaaagaacatggtaggcgcaacagacaaggtagagtgtttgcagagtagattcctctaaggtgttttcacagctgcctttagctgccttctcaccagccagccagagaggtttattttgtttttgctaatttgatctagttaggcatgtaaactgttcttaggtaaaattaggtttaatttttttcaaaatcctcatttctggatgatttataagcataaaataattaaaatgtactaatttctgtaaaagtataataaaactggagagcatacgtattaatgtacaattgtatgtatttgtttaatgttcttttaaattaaatatagtgctgttacttcaattataagcatatgcattgaataatagtttttgtagtacgtagataatatgtaattcctgcatgatacttgatgtcatggatactatagcaatctttgacatttcacttctgtatttaatgtcatttcctttctgctgcctattttcttatgaactataaggggctaggagtcctgcacccactagaaaggaatttggagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 434696 - DNA, 5449 bp, Homo sapiens
gagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggtgacaaccttttatttccatttctgctagatgtaaaattcttcactctattttaaaatgttttgcatgttttccaatctctagcttctggattttactgttttttctatcattattgctatttcttagcttttctctaaagaacatggtaggcgcaacagacaaggtagagtgtttgcagagtagattcctctaaggtgttttcacagctgcctttagctgccttctcaccagccagccagagaggtttattttgtttttgctaatttgatctagttaggcatgtaaactgttcttaggtaaaattaggtttaatttttttcaaaatcctcatttctggatgatttataagcataaaataattaaaatgtactaatttctgtaaaagtataataaaactggagagcatacgtattaatgtacaattgtatgtatttgtttaatgttcttttaaattaaatatagtgctgttacttcaattataagcatatgcattgaataatagtttttgtagtacgtagataatatgtaattcctgcatgatacttgatgtcatggatactatagcaatctttgacatttcacttctgtatttaatgtcatttcctttctgctgcctattttcttatgaactataaggggctaggagtcctgcacccactagaaaggaatttggaggtaaccatttacatttgttagcatgtgtgaatcgtggttcattaatgttttacacctgaaagacattttagatttgtttgataaaagtcaaaatgaatgacattctagtttaaaactaatccacaaataaaactaataaaggctttcatttcccaggtaggctgggattgttcatcaggcctaatttttttttaataaatgtggtcgattcatttacaaagatttaatacccaaaagttatattaattttaaaagtcattcaggtacagtaaatacagaacatttcccaagtatctgattagtgatacatttattttctagtggaaaagcttttggattagcaaagaactgtatgattttcttttcctttcttcataaggaaatttttattcacaaagggtcactttttgtttgaagtatagtttatttggtttacatgaaaactcacagagctcagttggagttatacatttgacaagtttatttaatctaaatctcaagaaaagatgagatgagttttcacaattcctcagaagaacttttacaaatccagtgttactaaggctcactgtgcatgtgtagcctggtctgtttctattgtagcttgcctagtgacatggctgagcaattcaggtcttactacagactgactttgcctgtgtgtagatcttaatgactgcgtgtgataagaatagctaaattatttcagcattacagcttctgccgaatacagctaagtgatcatttctccattgacctacagaaaacatttaatttttcccttttcaagctcctgcttttatagaaaacatttaatttttcccttttcaagctcctgcttttatttaaatttccatgataatttttgcttatcttctgctttaattaggaaaacatcctgtagaaaataaatttaaaatgaatctgtcaaaagttaggcaagccagtggattacagtgaaatctgtcttaattttaaaaattgctccccttcataattcttttgtaagtagtgtttgcaacatgttttttcatcctataaacaataattcctttacgtcattatagtacattagagtttttaaaattaatgcatcaaaaactaacttcaaaagacttacgtagtctcatagaaatttatgatttctttccttttgactatcaaatatcagagtttttacttgctctggatataaggagtaagatgatttttaaagcaaaggtcttcattaaacatattttttaaattccctactggtagtaattgcatacat

SEQ ID NO: 434697 - DNA, 305 bp, Homo sapiens
tgacttaagtgaggtcttctcaaaatgttttgtcactatactcaacattttaattgtaacttgtttttactaatgattctttgttttcttcttgttgcatccatagtttctgagcagacattacagtcaggtacagtatagaaaatcaatctataaataaaagcaattttttcttattttttctgaagtcgatattgtaaacaaataaagccatataattggaaactttctcattttgccatcagatcctaacaggataaattgatatcttgttttaatctgagaaaagaatttcaagcttgaga

SEQ ID NO: 434698 - DNA, 414 bp, Homo sapiens
aaggcttgccctcaaagtaccataccatgtgtacttaaatgattatgtatattcctcatttcctatgcacatggaactcttgaaatttcaaatctgcgatttagaattctttgtttcaaagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatggtaagctcttgctgcttgttcttgaagataaagctttgaaatatattttaatttgccccaaattctacatcaatgtttttggaaatttaagatagttcct

SEQ ID NO: 434699 - DNA, 800 bp, Homo sapiens
ttctttacaaaaaggagagtttatttaagatgctgcccttgatagtcactcctactccttttggctccaagagtaatttatttcattttatccttcagctacctttctaatgagtttgaacatatttttaacactgtcttccataaggcagatatttggtaataacatatgcctgtcttctgtcttaatgatgggattttgttatagaaatccgaaagatctcatcataagataaccttatccacagtgacatctacagcgtgaagccctaaagtattgctactaggagcctcttgtgtaatttgacaaatgcagtcctgtctgttgctcagaagccacttgtctgccagactctaaggggcagcagtgccgcatcttgtgaccattcacacagctgactgtatgttttcaaggttcacgagagagttctatggggaatgccaccctaaaagtggtcccatgagtgagatatcaaactaaagtcaccacttgtctcccataaaggtctatctaaatattgtaatttttctctcttttggagtatttcattcaggactgataatacccttcatcattatacaaagcaaagtgctttgttttgttaccatctcatgcccccatttctgctggtaatgaagcagaacagcaagctgatgttatgcaatattgcttaattgttaacttacaactaatttttttttcccttcttgcttcaaagcacccaaaagccctggaacaacaaggaaagataatataggtaaaaacacttgaatgtagctattcacccttaaaactggacc

SEQ ID NO: 434700 - DNA, 6941 bp, Homo sapiens
gagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtagacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttaatactttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 434701 - DNA, 826 bp, Homo sapiens
ctcataggatgtattttagtgataaatgagctttgaaatgtgaaccctcatttttgacagagagggcagcattgcatatacaaaaacaggagatttgaggccaaacagacctgagttggaaacccagtcccatcactgactagccatgaacctcagttttctcatttataaaatgggcctaacaccatcgagtgttgtagctggtgtgtgtaaagcaagcatgaaaggcacattttaggcattagaaatgcttgcttcctctctcctgcccattaatccagggtcttcctttgagaggagcagctcacagggacatgggtgctggatgagatgaaccagagtgcgcataatctcaaactttggggtgtttatgtagccataggacttacctcacccctaactggatgcttgtcttgttccctcgcaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgca

SEQ ID NO: 434702 - DNA, 2014 bp, Homo sapiens
gtggtggtggtttccgtgaacacgaccccctgcctcttcttccagaagccaatgggacagaagcaccaattctcccacaatagtttcacctgctattgtttcccccacccaggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggcctcccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaaaaaaaaatccacatacaaacaacaacaacactctttttgggccgcccggccccaaaaaaaagttttcaaaaacccaatcggttagggcgccggcgggcgcccagagggtaggtacaacctgggccatacggggtccccaaagaaaaccccggggccaaagactacgggctgggttccccccaataaaaaacgccgggggaacacgagcggtctgaacaatcccagaggatccagaggccaaagggggccatcaacaggggccaacgaggtcgatttaatc

SEQ ID NO: 434703 - DNA, 2001 bp, Homo sapiens
agctctttggctgcttttccagtttccgaggtgcccgcccccgcgcgcctgaggcagcgcagcccggagggcgaacgaatggcggttggcaaactttgagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggcctcccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaaaaaaaaatccacatacaaacaacaacaacactctttttgggccgcccggccccaaaaaaaagttttcaaaaacccaatcggttagggcgccggcgggcgcccagagggtaggtacaacctgggccatacggggtccccaaagaaaaccccggggccaaagactacgggctgggttccccccaataaaaaacgccgggggaacacgagcggtctgaacaatcccagaggatccagaggccaaagggggccatcaacaggggccaacgaggtcgatttaatc

SEQ ID NO: 434704 - DNA, 1570 bp, Homo sapiens
accggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgca

SEQ ID NO: 434705 - DNA, 1873 bp, Homo sapiens
gtggtggtggtttccgtgaacacgaccccctgcctcttcttccagaagccaatgggacagaagcaccaattctcccacaatagtttcacctgctattgtttcccccacccaggtaaccaaaccaaactctatgcatgaaatgtttctttggtaccacttcgggactaacttttgtgctaatgcagctctgggtaggggggaagttttaaaaagtaggtaatgtactgaatcggatttcgtttcacccttagaagttaactctcttggtgctttttgggaaactttacacctaaccttaaaagatgtgagagagggcatgctacctaacaaatcactgctgtgcagtaaggcgaaaaacttcaaagttcgccgaacaaaaggattagctcactcttgcagccgctcttcattgaatgcatgagttttataaggcaaagactgcgagaacactgtaaatgtaaaggaagcagttacttaagacatatttgaatcaagtaacccttaaaagactctattacgtattcgccatgaccttagaaggtagaaaaacagttataaattattgaaaagaaaacgtgccaatcccacttcctgtagcttttttttttttttttaaagaaaaggggtggagagtggagagccaggcagttgagtgccagtttatactgtaacatgtagttgaatgtaaactggcagtgtggggtgcaatttccataaactaaagtgggaacgtggtatctgcaattccagtcaggctacaaattggagtatgggcctgtggtgcccagcactgtgggcactgaaacattgctgtctccccctagccccacggagctcactatctagggggcagataatacctacgaagtagataattagagtaagagtgctatcccagcagctgagtcagcatggacaaatcacttcacttctccttggcttcactatcctcatcaaagaggaagaaactatttccaccctaacatgatttaagtctaagcagtgccaaattctgggtcgagactggggcctctagtgttagattcttctttccttattttccccaaggtagtattttcgtgagtattattaaagttatattcatgttttggacactctctagtctaggagtcagaaaccaggggtctttggacactgtgttctattctgcaggcaggagtacccactggaggttttacaactttgacctgcctgccatcaagcagaagtaggaattttgcaggtctgaaggtatagtgcaggccctccaggaacatatgtcaggtacctctgtgctttttccaaagtggaaattccagttctggacacactgaccctttcaaacgtttaccagctaatgggcaagcctcaaggccaactgagaaaggggctgcgagtggtaatataaacaccaaagttctctaaaatacacaagacctgtaggctatgtgtcttctgtacttcaggtgtgtagtctatttctgacaggttgtgttagtgaattttaagaatggagaggagaatttagggtttgctttttctttgaaagcaaaaataaatgttcatattcttctgatacagtaaaaacccttgaaatgccctaatttagaatagcacctgattaattaagagttaaaagtctaagaaagtttattaaggcgtgcatggccttgggataacaatgaaaccatttgtctactggcatctgtctgctggtttcttgacaccagtgtaatatagaattgtgacgtaaagaaccacaaaatataagagggtttcgtttcattggttttgttttgttctaaggaatgcagtctttcagtcattatcttttatttacctgagtaaaataaatcagttccaaaaaactgta

SEQ ID NO: 434706 - DNA, 1699 bp, Homo sapiens
ctcataggatgtattttagtgataaatgagctttgaaatgtgaaccctcatttttgacagagagggcagcattgcatatacaaaaacaggagatttgaggccaaacagacctgagttggaaacccagtcccatcactgactagccatgaacctcagttttctcatttataaaatgggcctaacaccatcgagtgttgtagctggtgtgtgtaaagcaagcatgaaaggcacattttaggcattagaaatgcttgcttcctctctcctgcccattaatccagggtcttcctttgagaggagcagctcacagggacatgggtgctggatgagatgaaccagagtgcgcataatctcaaactttggggtgtttatgtagccataggacttacctcacccctaactggatgcttgtcttgttccctcgcaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggcctcccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaaaaaaaaatccacatacaaacaacaacaacactctttttgggccgcccggccccaaaaaaaagttttcaaaaacccaatcggttagggcgccggcgggcgcccagagggtaggtacaacctgggccatacggggtccccaaagaaaaccccggggccaaagactacgggctgggttccccccaataaaaaacgccgggggaacacgagcggtctgaacaatcccagaggatccagaggccaaagggggccatcaacaggggccaacgaggtcgatttaatc

SEQ ID NO: 434707 - DNA, 2452 bp, Homo sapiens
gtggtggtggtttccgtgaacacgaccccctgcctcttcttccagaagccaatgggacagaagcaccaattctcccacaatagtttcacctgctattgtttcccccacccaggtaaccaaaccaaactctatgcatgaaatgtttctttggtaccacttcgggactaacttttgtgctaatgcagctctgggtaggggggaagttttaaaaagtaggtaatgtactgaatcggatttcgtttcacccttagaagttaactctcttggtgctttttgggaaactttacacctaaccttaaaagatgtgagagagggcatgctacctaacaaatcactgctgtgcagtaaggcgaaaaacttcaaagttcgccgaacaaaaggattagctcactcttgcagccgctcttcattgaatgcatgagttttataaggcaaagactgcgagaacactgtaaatgtaaaggaagcagttacttaagacatatttgaatcaagtaacccttaaaagactctattacgtattcgccatgaccttagaaggtagaaaaacagttataaattattgaaaagaaaacgtgccaatcccacttcctgtagcttttttttttttttttaaagaaaaggggtggagagtggagagccaggcagttgagtgccagtttatactgtaacatgtagttgaatgtaaactggcagtgtggggtgcaatttccataaactaaagtgggaacgtggtatctgcaattccagtcaggctacaaattggagtatgggcctgtggtgcccagcactgtgggcactgaaacattgctgtctccccctagccccacggagctcactatctagggggcagataatacctacgaagtagataattagagtaagagtgctatcccagcagctgagtcagcatggacaaatcacttcacttctccttggcttcactatcctcatcaaagaggaagaaactatttccaccctaacatgatttaagtctaagcagtgccaaattctgggtcgagactggggcctctagtgttagattcttctttccttattttccccaaggtagtattttcgtgagtattattaaagttatattcatgttttggacactctctagtctaggagtcagaaaccaggggtctttggacactgtgttctattctgcaggcaggagtacccactggaggttttacaactttgacctgcctgccatcaagcagaagtaggaattttgcaggtctgaaggtatagtgcaggccctccaggaacatatgtcaggtacctctgtgctttttccaaagtggaaattccagttctggacacactgaccctttcaaacgtttaccagctaatgggcaagcctcaaggccaactgagaaaggggctgcgagtggtaatataaacaccaaagttctctaaaatacacaagacctgtaggctatgtgtcttctgtacttcaggtgtgtagtctatttctgacaggttgtgttagtgaattttaagaatggagaggagaatttagggtttgctttttctttgaaagcaaaaataaatgttcatattcttctgatacagtaaaaacccttgaaatgccctaatttagaatagcacctgattaattaagagttaaaagtctaagaaagtttattaaggcgtgcatggccttgggataacaatgaaaccatttgtctactggcatctgtctgctggtttcttgacaccagtgtaatatagaattgtgacgtaaagaaccacaaaatataagagggtttcgtttcattggttttgttttgttctaaggaatgcagtctttcagtcattatcttttatttacctgagtaaaataaatcagttccaaaaaactgtatactgatgcttttattattcttgcattattgtcaggtaactcctaagttaaatatagatttgagtgtccatatatggcttatatgattattatggctctcaaacaagatcttagctccaagtccctgttagttaaaacactacaaaaagttttcagtttgcacatttttagtagtcagcttttcacttatgaagtctgagcagtcgaagtattgctcagtagaaagctgagagcaaactttttccttctttgtatattaaaatcactgtaagagttgaggttcagtgcatttcctggggcttaatgcctagctgaggttgctggcctgtggcattgctttgggtcatcaactcttctggctggtcattaatccgcaggaaatgccctgtgcagctccagcttcagtcattattacttaatcataaacataggctctctagcctaatactgactggactttatcaagtagtgtcatacggaattccactgttgaccatcttagagacatctcgataacagacaggtcacacactgatgttttgattttctactaatgttgcaagtttccctaaagatgaa

SEQ ID NO: 434708 - DNA, 2443 bp, Homo sapiens
accggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggcctcccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaaaaaaaaatccacatacaaacaacaacaacactctttttgggccgcccggccccaaaaaaaagttttcaaaaacccaatcggttagggcgccggcgggcgcccagagggtaggtacaacctgggccatacggggtccccaaagaaaaccccggggccaaagactacgggctgggttccccccaataaaaaacgccgggggaacacgagcggtctgaacaatcccagaggatccagaggccaaagggggccatcaacaggggccaacgaggtcgatttaatc

SEQ ID NO: 434709 - DNA, 2034 bp, Homo sapiens
gcacgagccaccacctgcctcaccagtagctgggactacagctcccgtcactagctttttctcctcaagcctgcactgcacaccaactgggatggagggtgcagatgaataaaggcaaatccatcaccaaaagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggcctcccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaaaaaaaaatccacatacaaacaacaacaacactctttttgggccgcccggccccaaaaaaaagttttcaaaaacccaatcggttagggcgccggcgggcgcccagagggtaggtacaacctgggccatacggggtccccaaagaaaaccccggggccaaagactacgggctgggttccccccaataaaaaacgccgggggaacacgagcggtctgaacaatcccagaggatccagaggccaaagggggccatcaacaggggccaacgaggtcgatttaatc

SEQ ID NO: 434710 - DNA, 1164 bp, Homo sapiens
accggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagagg

SEQ ID NO: 434711 - DNA, 784 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaa

SEQ ID NO: 434712 - DNA, 925 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaaaaaaaaaaaaaaaaaaaaaaaaaaaaaaaaatgggggtttttttcgggggggcggaaaagaggtttaagggcgtgttttttttcggcccttttttttaagggggaaatggggccccaaggggggataatgaaacaggatag

SEQ ID NO: 434713 - DNA, 689 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttgtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaa

SEQ ID NO: 434714 - DNA, 803 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttgtaagtaaataatacatttttaaaacttttattgaagtattctttgcactgttattttacgaataattgcctgttatgtatgtatacttctttttttatttttatttttttttattattatactttaagtttcagggttgtatgtatacttcttgtgttgaatataataattatatccggccgggcacggtggctcacgtctgtaatcccagcactttggggggccaaggtgggcggatcacctgatggcaggagttcaagaccagcctgaccaatataatgaaaccccgtctctactaaaaatacaaaaattagcccggtgaggtggcatgcacctgtaatcccagctacttgggaggctgagacagaatca

SEQ ID NO: 434715 - DNA, 1142 bp, Homo sapiens
gaggattcagttataaacattacagttttgaaactcagttcattagttcttttttttttttgagatggagtctcattttgtcacccaggctggagtacaatggcgtgatctctgctcactgcaacctccacctcccaagttcaagagtttctcctggctcagcctcctgagtagctgggattacaggcacgtgctgccgctgccacgcccagctaatttttgtgttttttagtagagatggggtttcaccatgttggccaggctggtcttgaactcctgacctcaagtgatccacctgccttacaggcgtgagccaccttgcctggcctagttctttttaaaaattaaatctttgggctgggcttggtggctcatccctgtaatcccagcattttgggaggctgagacgggtggatggcttgagcgcaggagtttgagaccagcttgggcatcatagcaagaccctgtctctattaaaaaaaaaaaaaaaaattagtgtagtggtgtgccctatagtcccagctccttgggaggctgaggtgggaggatctgctcacgccactgcacttatcctggaagacagagtgagaacctgtctcaaaaggaaaaaaaaagaaaaaagttagatcttttgttaggttatttttggtatttaaacttatttctttgattgagatcagtgtatatgccagtaaaaatttcttaagataaataccatgtcaaaaatcagcaaaatgttttcaaatcttagctcttaatcttaaatgatactgaacaaagtttttattaatcaaaaagtgtgttggagcatccattgagttctgttaaaaaaggtgatttagcaggaacattttgcgcaactttgcttttgaggaatattatattctgtttttttccctctcttttccaccagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaa

SEQ ID NO: 434716 - DNA, 522 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggattcacagattaatctcttgaggtaaggaatgtaaccaaatgtattttgaactgttgcatatagaactttctcttatttttcattattcttgaaaatataagcatgtagtcttatttttaagtggatgtggtagtataaattagaaatttaagttttggaatataaatccttgctgtatatttctagtttcttgcacagctgctgttgatagatacttttttagccttatttggaaaatatattttaatagtataattagtaatctgagtgtgtttatttcaccactactgtgtgctgggttatcatactgtacaaagtagacttagtaatttctactttttt

SEQ ID NO: 434717 - DNA, 1474 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaaaaaaaaaaaaaaaaaaaaaaaaaaaaaaaaaaaaaacaaaaaaaaaaaaaaaaaaaacaaaaaaaaaaaaaaaaagaacgaccaacaaaggatagagaagaaagaatgagaagccaagaagcgggaagtcactatagatgtcgacaccagagggcgcgccagatgaaaaatctccagagcgcagggagagaacagcgagtcaggagcaagaggggcagagcagagacaaagacaaagtagaagaacacagagcaaacgacaggactaagaagataaagacgagagagaaaaaaaactcgatacgcacaatgccaacaaaactcattgcaggagatagtaagagaaagccaaagagaaag

SEQ ID NO: 434718 - DNA, 2711 bp, Homo sapiens
tctacatttttgaaagacaagaattaagtttgattgagaaagatgtttttaaaactttgaaactcataattgctctgtttttgctgttgttagtggcataagaagggactggctgtgttattctgcatattgcagttcttgtcaatgacctggtaagtctttccttaccctagtgaagtgttaaaattgcctgagatgtgacgagcattttgtttgggacctgtgaagccctagcatttcgtctggtgttttggagccagacaggccctgcagggtcagaggaggggaggtctgcgatgagtcctgttgcacttgacagcgtggctcagtggtactgttcgggagaagtatggggtgctgtgctcgtagagttacatagtgatatgttctgcttttttctaatgtgagaaagagaaataataagaaaagtaggtgatgccatgtgagtacataaaagtgagaccaaatcacagggtgagtccaagggaagatgagtttacctgcattctccactctattgctggataaatacaacgtggaatttatcctgatgttgactctgtggccctgtgatatctggagatgtcttctgaattggcagtgattaaatacttcttaagttactggttgagcatcccaaatccaaaatgcttcaggatccaaaactttttttttttttttttgaggcagagtctcactctgtcacccaggctggagtgcagtggcattatcttggctcactgcaacctctgcctcccgggttcaagtgattctcgtgcctcagccttccaagtagctgggattacaaatgtgaggcaccatgcccagccccaaatccaaaacttcttgaacgctgacatgatgctcagatttggttgatactcaaccagtaaatgtaatgcagatattccaaaaatccagaaaaatccagtatccaacacatttctagttcctatcatttcagatcagaggtgcttcacctgcactgcctttcccagtccacttttgtgaagattcagtcatgtcctggtttctgctcagactctcctccttgtagcctttttgtgtctcgcacagtaagagttcatctgcataaaggccataaatatctgggtggttgattaaacgtgccctgcagctcctgcgctcttctgtgttagtgaagagtacttttccttttcctttagagcagctcttgcttcctaatttttgcttcctggttttgccattttacattcctcttactcgacattacccagtttgggatcacctttctttcggccttctttctactgacagatgaaacatcagtgaatgttaaatgtaattctctgtatatctcaaattcaccataaaatgttctttactttttttcactgatatgtgaagaaacttaatctcttggttattttctctagtattttgccttttattgcctaatttgtaactaataattgatttatccctaaaggagactataattatcagttgtggtacagtttctattttattataagaagctcaaactttagcatgcaccagaatcacctagagagtttgtttaaagtgcaggttgcttgttaaagcaagcttgtgatttaggaggtttaaggtaggacctaataatttacatttttaacaagttcccagatgatgctctcactgctggtcggggtcacactttgagaaccactgtacagtctcatgctgctgtatttattataaggttagacatggccttttggcataaaggaaaaccatcattcagatgaagattcaacatgcttgaatatttcttgcaggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434719 - DNA, 807 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggattcacagattaatctcttgaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaa

SEQ ID NO: 434720 - DNA, 1845 bp, Homo sapiens
atggggtgcagtcaccccaccccacccctggcctgcagccaatgaccggccgaagggaggtggcgtgtggaaggccagcctctgcctccagcaggacttgcactgagtgcggatgcactcggatgcactcagactctggcatctaggagcctgaggaattcgtcctgcagaggcagagagaacagataatgaacctgtgtactctttcccagcctctgcagtttcagtgttttgcctggcctgttgcatctgccccctgtgtttttttaatctttgtatattttataatatatcttatatgtcattttatccatatcagtgtatatcggctgtccctaacagataaggacttttgtgaaacatattatcagactttgcaaaattaatggttattcctcagcatcatctgctacccagaccatggtcatattacccttaacaaccgtggaatcttagtattcttgaatgacactgtgatatgcaaaataaatgattcagactatgtgttaaaactttgctttaatttagtataaagaatcagattggtagtgaattaagactatattctaaattttcccattttttattagtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434721 - DNA, 1304 bp, Homo sapiens
agttccttatcggtcattactactaggatcatggcctgactgcgcaggtcctggatgcctcatcccttgggggcaacaccaggatggaaatggcctgccatctggtgaggatgtggcgtggggtggtgtataattggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434722 - DNA, 3107 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggattcacagattaatctcttgaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtaagtctttccttaccctagtgaagtgttaaaattgcctgagatgtgacgagcattttgtttgggacctgtgaagccctagcatttcgtctggtgttttggagccagacaggccctgcagggtcagaggaggggaggtctgcgatgagtcctgttgcacttgacagcgtggctcagtggtactgttcgggagaagtatggggtgctgtgctcgtagagttacatagtgatatgttctgcttttttctaatgtgagaaagagaaataataagaaaagtaggtgatgccatgtgagtacataaaagtgagaccaaatcacagggtgagtccaagggaagatgagtttacctgcattctccactctattgctggataaatacaacgtggaatttatcctgatgttgactctgtggccctgtgatatctggagatgtcttctgaattggcagtgattaaatacttcttaagttactggttgagcatcccaaatccaaaatgcttcaggatccaaaactttttttttttttttttgaggcagagtctcactctgtcacccaggctggagtgcagtggcattatcttggctcactgcaacctctgcctcccgggttcaagtgattctcgtgcctcagccttccaagtagctgggattacaaatgtgaggcaccatgcccagccccaaatccaaaacttcttgaacgctgacatgatgctcagatttggttgatactcaaccagtaaatgtaatgcagatattccaaaaatccagaaaaatccagtatccaacacatttctagttcctatcatttcagatcagaggtgcttcacctgcactgcctttcccagtccacttttgtgaagattcagtcatgtcctggtttctgctcagactctcctccttgtagcctttttgtgtctcgcacagtaagagttcatctgcataaaggccataaatatctgggtggttgattaaacgtgccctgcagctcctgcgctcttctgtgttagtgaagagtacttttccttttcctttagagcagctcttgcttcctaatttttgcttcctggttttgccattttacattcctcttactcgacattacccagtttgggatcacctttctttcggccttctttctactgacagatgaaacatcagtgaatgttaaatgtaattctctgtatatctcaaattcaccataaaatgttctttactttttttcactgatatgtgaagaaacttaatctcttggttattttctctagtattttgccttttattgcctaatttgtaactaataattgatttatccctaaaggagactataattatcagttgtggtacagtttctattttattataagaagctcaaactttagcatgcaccagaatcacctagagagtttgtttaaagtgcaggttgcttgttaaagcaagcttgtgatttaggaggtttaaggtaggacctaataatttacatttttaacaagttcccagatgatgctctcactgctggtcggggtcacactttgagaaccactgtacagtctcatgctgctgtatttattataaggttagacatggccttttggcataaaggaaaaccatcattcagatgaagattcaacatgcttgaatatttcttgcaggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434723 - DNA, 2434 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtaagtctttccttaccctagtgaagtgttaaaattgcctgagatgtgacgagcattttgtttgggacctgtgaagccctagcatttcgtctggtgttttggagccagacaggccctgcagggtcagaggaggggaggtctgcgatgagtcctgttgcacttgacagcgtggctcagtggtactgttcgggagaagtatggggtgctgtgctcgtagagttacatagtgatatgttctgcttttttctaatgtgagaaagagaaataataagaaaagtaggtgatgccatgtgagtacataaaagtgagaccaaatcacagggtgagtccaagggaagatgagtttacctgcattctccactctattgctggataaatacaacgtggaatttatcctgatgttgactctgtggccctgtgatatctggagatgtcttctgaattggcagtgattaaatacttcttaagttactggttgagcatcccaaatccaaaatgcttcaggatccaaaactttttttttttttttttgaggcagagtctcactctgtcacccaggctggagtgcagtggcattatcttggctcactgcaacctctgcctcccgggttcaagtgattctcgtgcctcagccttccaagtagctgggattacaaatgtgaggcaccatgcccagccccaaatccaaaacttcttgaacgctgacatgatgctcagatttggttgatactcaaccagtaaatgtaatgcagatattccaaaaatccagaaaaatccagtatccaacacatttctagttcctatcatttcagatcagaggtgcttcacctgcactgcctttcccagtccacttttgtgaagattcagtcatgtcctggtttctgctcagactctcctccttgtagcctttttgtgtctcgcacagtaagagttcatctgcataaaggccataaatatctgggtggttgattaaacgtgccctgcagctcctgcgctcttctgtgttagtgaagagtacttttccttttcctttagagcagctcttgcttcctaatttttgcttcctggttttgccattttacattcctcttactcgacattacccagtttgggatcacctttctttcggccttctttctactgacagatgaaacatcagtgaatgttaaatgtaattctctgtatatctcaaattcaccataaaatgttctttactttttttcactgatatgtgaagaaacttaatctcttggttattttctctagtattttgccttttattgcctaatttgtaactaataattgatttatccctaaaggagactataattatcagttgtggtacagtttctattttattataagaagctcaaactttagcatgcaccagaatcacctagagagtttgtttaaagtgcaggttgcttgttaaagcaagcttgtgatttaggaggtttaaggtaggacctaataatttacatttttaacaagttcccagatgatgctctcactgctggtcggggtcacactttgagaaccactgtacagtctcatgctgctgtatttattataaggttagacatggccttttggcataaaggaaaaccatcattcagatgaagattcaacatgcttgaatatttcttgcaggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaa

SEQ ID NO: 434724 - DNA, 1792 bp, Homo sapiens
gaggattcagttataaacattacagttttgaaactcagttcattagttcttttttttttttgagatggagtctcattttgtcacccaggctggagtacaatggcgtgatctctgctcactgcaacctccacctcccaagttcaagagtttctcctggctcagcctcctgagtagctgggattacaggcacgtgctgccgctgccacgcccagctaatttttgtgttttttagtagagatggggtttcaccatgttggccaggctggtcttgaactcctgacctcaagtgatccacctgccttacaggcgtgagccaccttgcctggcctagttctttttaaaaattaaatctttgggctgggcttggtggctcatccctgtaatcccagcattttgggaggctgagacgggtggatggcttgagcgcaggagtttgagaccagcttgggcatcatagcaagaccctgtctctattaaaaaaaaaaaaaaaaattagtgtagtggtgtgccctatagtcccagctccttgggaggctgaggtgggaggatctgctcacgccactgcacttatcctggaagacagagtgagaacctgtctcaaaaggaaaaaaaaagaaaaaagttagatcttttgttaggttatttttggtatttaaacttatttctttgattgagatcagtgtatatgccagtaaaaatttcttaagataaataccatgtcaaaaatcagcaaaatgttttcaaatcttagctcttaatcttaaatgatactgaacaaagtttttattaatcaaaaagtgtgttggagcatccattgagttctgttaaaaaaggtgatttagcaggaacattttgcgcaactttgcttttgaggaatattatattctgtttttttccctctcttttccaccagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434725 - DNA, 383 bp, Homo sapiens
ctggattgctgtggcttccgggcggcataaagctttttgcagtgttttataccctcggcaatcttgctgcgttagccaggtacgtttggcttctcaaaatatcttgtttgctcttgctaccaaatttacctttctaataagcactttcccagtaggatgtttatgtagttctgtacatactgtgaattcagccacaggatttacattcattaaataaatatgtattgactgctgctgtatgccgtctcccataacagacggtattagtgctaggaatagccagcctttgtggggcacttaatgtgtgtctgggactgttctaagtgttttgtatgtattatgacgagcttgtgaggtaggcagtattatcatccccgtttata

SEQ ID NO: 434726 - DNA, 1150 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaacagaggacctgagtgaatgtgaccttaaactgttgctcaatgtgaggccagtagtgtgggag

SEQ ID NO: 434727 - DNA, 1143 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaaaaaaaaaaaaaaaaaaaaaaaaaaaaaaaaaaaaaacaaaaaaaaaaaaaaaaaaaacaaaaaaaaaaaaaaaaagaacgaccaacaaaggatagagaagaaagaatgagaagccaagaagcgggaagtcactatagatgtcgacaccagagggcgcgccagatgaaaaatctccagagcgcagggagagaacagcgagtcaggagcaagaggggcagagcagagacaaagacaaagtagaagaacacagagcaaacgacaggactaagaagataaagacgagagagaaaaaaaactcgatacgcacaatgccaacaaaactcattgcaggagatagtaagagaaagccaaagagaaag

SEQ ID NO: 434728 - DNA, 431 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcagatcaatacacggaagatggcaataggaggaaaaaatacctactattatacaaatagccgtgctgtttccttgctgagagaaaaactggctattgaaaagcagcgattgaacttgtgaacaatggggtgatttgaacttgcaaaagaaggaaaaatggatgctttttcctctcactaaatcctcacagcattgtggactcacacgaacctttagaaatcattattctttccatttttaattgacaaataaaagt

SEQ ID NO: 434729 - DNA, 1434 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434730 - DNA, 1457 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggattcacagattaatctcttgaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434731 - DNA, 1339 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttgtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataaaaaaaaaaaaaaaaaaaaaaaaaaaaaaaaatgtgtgtgtgtggggcggcttgtgggccccttggaaaagagttttttgaagaaccttgtgtgtggggacgacggggccccagaagagggtaacggcacaaacgtggccaaaaggggttccccaagaaggaaacgcggggacgataagaaacacaagggcgggggatatctcgccaacaagataaaaagagcgccgcggggaaaaacacggagaggttctcggaacaaatcgcgcaaagggagtctgaagaggactcaaaaagggggatcatttaacaggagggatcccgagagagagccaggataacaaattaggcccg

SEQ ID NO: 434732 - DNA, 725 bp, Homo sapiens
agcgggggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttgggtaagttatgtcagccctactggctttcagttaactgtgtgccccccaccccagctgacgtgtcatcacaccattatcttaaaatagctcatctgtttttttaaaactctctaaagattaggtgttcctaaaatttgacatgttaccatccagctagttgctaaaaatgccatagattctactgtctacagcatagaggtagtcagtgaacacacatgtgcacacatgctcacccacccagctggtggctaaatgtgcc

SEQ ID NO: 434733 - DNA, 911 bp, Homo sapiens
aaggaaaggggtttgcctgaagaagggaagacagtcctctaaaggtgtattggatcaccacctcttatcagatagaaactatcttcagcatttaaacagtggttctgttttagagtgtacctagcacattttgaaataccctagagtctgttttctctaagcacctggacagggctttgcaggtgtccttgacatatgccctcagcttgacccattgagtggacctagtttgaccaccatctcttatattccgcatgctctttaatgacattgaatatttacttgtctttgccttattttcttaattcattcgtagcttgctcctgagccttaaattactttgaagtgtattacacatcctttgtatcctctatggaatctcattcatagtagggtctgtgataaacaattgattggatagtgaatatctcttacaggcatgtaaggaggaatcaagaagctgtgacatattctgaggacctccaaagaacaacttgctactgactggacttctctcatcttttagcatgtgaagttttgcaaatataatccactttgctctgaatgtcctgacacctgcttcagagctcaagattcagactccagcctgaatgttatttcctgagaaaatccctccctgacccactgtgctggttaggtccacctgctaatcacatccacaaaaccctctgcttctccttcaaaacactcatctcctctgtaatgatcagatgaactcatgtctttctcagaggacaataaatttgatgaatggggaccatggaagtttatttccatctgtatccctacatctaactcatctgctggtacctatttgtcatgtatttaataagtacaactacctatgccaccctgcaataaaatgatattgttactttctcttctttagc

SEQ ID NO: 434734 - DNA, 1465 bp, Homo sapiens
gtagtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaaggcatgtaaggaggaatcaagaagctgtgacatattctgaggacctccaaagaacaacttgctactgactggacttctctcatcttttagcatgtgaagttttgcaaatataatccactttgctctgaatgtcctgacacctgcttcagagctcaagattcagactccagcctgaatgttatttcctgagaaaatccctccctgacccactgtgctggttaggtccacctgctaatcacatccacaaaaccctctgcttctccttcaaaacactcatctcctctgtaatgatcagatgaactcatgtctttctcagaggacaataaatttgatgaatggggaccatggaagtttatttccatctgtatccctacatctaactcatctgctggtacctatttgtcatgtatttaataagtacaactacctatgccaccctgcaataaaatgatattgttactttctcttctttagc

SEQ ID NO: 434735 - DNA, 1431 bp, Homo sapiens
aaattactgattatttttgtttagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataaagttgctgtgaatacttacgtgtaagtc

SEQ ID NO: 434736 - DNA, 2398 bp, Homo sapiens
gtagtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataaagttgctgtgaatacttacgtgtaagtc

SEQ ID NO: 434737 - DNA, 4352 bp, Homo sapiens
cgaaatgagagcaaaaagggagagagcaggaaagcgagcacaggcgagtacagtatacaaagtgttttgagtttctgactggcgtgccggaaagatcatgttagcacacccagaaacttcacacgatgcagaccccagaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttag

SEQ ID NO: 434738 - DNA, 6044 bp, Homo sapiens
ccaggttaagggcgccctctggtgggtactcgggaaactgacccttcgaaagggacacggaccagttctcctcaaggcatcgccctttggtggaatctgtctgctggctcctgtcccccgttccacaggtatctccgttctccttgttgagcaataccaactggctgtctgtgaggatgcaatacttccgctcccacgttgttgtctcggtgtagggtgactgaccacaagacagacggtggctgggtggtcctttcacatcgtacacccggacccagctctgttgctggcacacggactccagaaggatccgatccaacatgccaccggcgacggctccactgactgggacaaccgcgtccaggtcctccgggggcagcggcgagtcggactccagcgccgggaacatctccggccaggacagcgcctcggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttcccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaactgtcagtgtcccttccgagggtcagtttcccgagtacccaccagagggcgccactaaactggaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggtcataaatggagatgagattattcaaacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattttttcaacaggtctggaacgttattctttttcccagggggcagtctcttgagggacctgttaccacactgggtcct

SEQ ID NO: 434739 - DNA, 4339 bp, Homo sapiens
ccagcactttgggaggctgaggcaggtggatcacctgaggtcaggagttcaagaacagcctgaccaacatggtgaaacaccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggtcataaatggagatgagattattcaaacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattttttcaacaggtctggaacgttattctttttcccagggggcagtctcttgagggacctgttaccacactgggtcct

SEQ ID NO: 434740 - DNA, 468 bp, Homo sapiens
ccaggtgcccagtaaactggttttcatgtctctcagcagccctgtgctcccaggaaaatcttgtccctgaattcagcctctgcctctttttgagtcatttcatgctacaaggcacaggcctgcatcagccactttctaacaggaactgcaaaaggatgagcactcctttggtgagtggcagaagcacctatcctggaccttgtagcttaggggccatagggatcctagtggtgatcataaggatccatttcttaaatatcagaccagagaatgtgccacctttcacccctgagcatgaggagacactgtggctcccaggatctctctatgtgactcaggtggagaacagagaagggcttcctcctatgagaagcaaaagcagctgcctagttactgttgcaagtgatatctccgctgtgttaaattacaggtcataaatggagatgagattattcaaacaggcaagta

SEQ ID NO: 434741 - DNA, 246 bp, Homo sapiens
ctggtttattgtgaaaaaccagtaactttacagttcagtggaagatcctaaatttggggttcttaatgatgtttcaactttcctccttttttccagaggtaccagcagaaaggtcccctcgtagacggagtatctcagggaccagtacatcagagaaacccaactccatggacactgcaaatacctcacccttcaaagtaccagtaagtgtttatcttctttataagaatattttacttttccttt

SEQ ID NO: 434742 - DNA, 546 bp, Homo sapiens
tcctcctatgagaagcaaaagcagctgcctagttactgttgcaagtgatatctccgctgtgttaaattacaggtcataaatggagatgagattattcaaacaggcaagtaaaccccgcgtccgttctctagctgagcagttcccagccctggcccagtgcactggcctcctacacattccagctcctgccactccccacatgggaatccttcctgtcaggtgtggactagattgctttcccttacaatccaggcagaattgaaatgtccgagcatcttttgtcaactgaacttgactttcataagtctctatttgattttttttaacttttttgttttattttgagaggttggcaatagggggaaatacaaagggagtttctttatgtggaaactttcagctgtttagtaggggggctgtttgtcttcagttgttacctttttaggcagtaagtaattacagtcattcttaggctttttgaccctttaaaaatcaaattttttatgaattatttatttttggatgaaccctggagaatcctaattt

SEQ ID NO: 434743 - DNA, 814 bp, Homo sapiens
gaaggcggctccgaggaggtgggagggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttcccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacggagaccgatgattaacagcaaaaacaatagccaacgccatagacatttcagctggttcattttacacaattctgactctgctcagtgggtgccaaaactgttgctcccagatcaattgcagacaagagcagagctttcactggaaatttcaaacaggtgggatcaacattctgaaggatttctttgaagaattttaacaataaatgaacatggttttaccagtacatcctgaagacaaagtacaatcaaatcactggctacca

SEQ ID NO: 434744 - DNA, 1446 bp, Homo sapiens
ccaggttaagggcgccctctggtgggtactcgggaaactgacccttcgaaagggacacggaccagttctcctcaaggcatcgccctttggtggaatctgtctgctggctcctgtcccccgttccacaggtatctccgttctccttgttgagcaataccaactggctgtctgtgaggatgcaatacttccgctcccacgttgttgtctcggtgtagggtgactgaccacaagacagacggtggctgggtggtcctttcacatcgtacacccggacccagctctgttgctggcacacggactccagaaggatccgatccaacatgccaccggcgacggctccactgactgggacaaccgcgtccaggtcctccgggggcagcggcgagtcggactccagcgccgggaacatctccggccaggacagcgcctcggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttcccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaactgtcagtgtcccttccgagggtcagtttcccgagtacccaccagagggcgccactaaactggaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtaggaagttaactttct

SEQ ID NO: 434745 - DNA, 1039 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggttgttacgagttatgaacatgttttaaaatatattttggttatataacttgcctctgctcttgtgcctcttgccctgtttatatagtgctactctttgctatttccctctggcagtctgccttcttgggtcaaggaagaaaagttactgttgccaggctttgggtgacttgtagcccttaagattcggctgaagctgattaga

SEQ ID NO: 434746 - DNA, 187 bp, Homo sapiens
gcggccgcctactactactactgctcgaattcaagcttctaacgatgtacggggacatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434747 - DNA, 607 bp, Homo sapiens
gaagaacatgacccagtcctgaaatctggagaagatggccatatttccactgaatagaattgtcagaaaatctagatcttcaggcatcttggggaaaatcagtgcaagaatcctcagggagtcatttgttcaaataacctaatctaggcctttggaattgttaatttgtatgaatagcactagtttgaaatatagtaaatatcaagctgttctgttttgggtttgtttttgtttttgttttcaattttcttctggtgatttgcctctttagctcttcaaaggaatctaaagacagcaagacatcatctaaagatgacaaaggtaaagaatttttttccctatttatttcagtgttgacattgtgtattttcattaaaaagtagtagttgcgcggtgttttctttgacatttagtccttaaaaattttattgacagactagaaacttgagatggtctttatataaactgtggaattatatatattacagaaaactgattgatgtgttactgtttacttactttgtaaactggtaatggggtacgttaaaaacccattagctagggaacacttacctggtgtgttctaagggactgggtcatgttctgt

SEQ ID NO: 434748 - DNA, 1229 bp, Homo sapiens
ggttcagacctcacgggactgttgaaaagagtaaatgatttattttggataaagtaccaagaacagtgcctggtatttgcagtgatgatttgttctttgttctctgatgtttttttcttttaaacctttttcagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttaattgcacacgaagacccagactacggaaagcgcagcccacacatggccacaagacgcgcagggaacgaaaaacacgaaggaaataccaagaacccttgggccagaagagagctctgggtaccacaagggactaatagcaagaacgggccggaacaagccagcacagcaggacacaagcgacaccaggagtgacagacaagcaaaccacactcgcggagcacggagggcgcgacagacgggaacactcaccacacaggacaacgggtaaccaccgacaccagtgatacacgacggcagacagactataacgaaccccatcgaaagaacgcacacaacaatatccgcagaagcgcaagaatcacccgcgtcgacgccagcccgcagcacaga

SEQ ID NO: 434749 - DNA, 4638 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434750 - DNA, 4392 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434751 - DNA, 4877 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaagcttccctaactgtttatcaaagcaagtctaatttgatggctagttctcaactcatagctgttaacagtagcagggagtagaatttgcagtgatttttaatttttatgtatttgtagtttttactctccttatatttttcctatcgtttccaaattttctgccattagcacacttcttataatcacaaaaatgtaaccatatgtacaaattgtttttctggttcgaacctttcaggtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434752 - DNA, 4169 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434753 - DNA, 4027 bp, Homo sapiens
agtctagacatccccttgaatcatcatcctgctgtgtatattacacttacattacatctcaatagagactagtcatatttcaaatgagtcctatgtagactagtgacttcggtactagtagtccagggctagaggaaaatgttcatacggaagagtaacagaggttcaagttggaggtaggggtcaaactcagagggggtctagaatgccactaagagaaagtggaaagcctttgaaggattttgagtagatagtagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434754 - DNA, 4969 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtatgtgtctttgttttcagcgttttaggtgttagtcgtccagttctttctgtagttcagcccaaggtgactgactagatatagagctataaaggcattcttttggtctttgttcttcagaaataaatctagcttagactcttcacctcagtagctgggcagcacatgctgttcacatgttagagacttaaccactaatcctatggcttttttaaaggcatctcttttaggaaagcccttcaaggtaaatgctgctctttcaaaaaagcttcccacatccctctatataaatcagtgaagaaaaatccaaatgtctagattttggtaa

SEQ ID NO: 434755 - DNA, 4285 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaaccttt

SEQ ID NO: 434756 - DNA, 4856 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaagtaagtctctgatcaggatggttgtatactacttcagctgtttacaaaagaagataattctgtttttccataaccatctttgcgtacttgcatgctagcaaacccaagaaaaaggaaatgttactagtcatttgaactttttaaatgacctactaaacttgaaaaataaagccccaaaatattttaatttctagtgttcttctaatttttttctacagattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434757 - DNA, 4485 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagttggttcttcattctgtgttgtctgaaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434758 - DNA, 3838 bp, Homo sapiens
  misc_feature (3813)..(3813): n is a, c, g, or t
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagttaaggcatcccaattatagaattgtccacatcggggcatcctgccaggaggaagggtcgggatagccctagggggagcgcgcgagaatcgtaatgagccgtgggggtaagaatatgcaaacgggaaatgagatagaagaccgcatcgagagagagattaacaaaagatgccggagaaggtcgtgttgtctttctctctcgtctctgagtctctgtgatcatattgtatccntcaagaaaccaaaagaaaaagacaa

SEQ ID NO: 434759 - DNA, 2894 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaaggaacgtcgtaaggaagctgaacggattgctcgagaaagagaggaactcagaaggcaacaacagcagcttcgttatgaacaagaaaaaaggaattccttgaaacgcccacgtgatgtagatcataggtagttactcattttattccttaacagttaaccttgctgttttattccctttaggctaagactagagaattagaaagtacaggctcccatcactggaataaaagtcatgatcaacagggatgggaaggattacagtactggggtagacccagtgcactagcaagtgggaacagtctgtgtttctttccctgtctacctttctgatgccaaatgtttttcattatgactggaaatacattgtcatagtaggcttcaataataattaaacagattttgaacattctta

SEQ ID NO: 434760 - DNA, 2546 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaatgatgaaaagagtagttcaagaagttctggagataaaaaaaaatacgagtgatagaagtagcaagacacaagcctctgtcaaaaaagaagaaaaaagatcgtctgagatctgacaacaga

SEQ ID NO: 434761 - DNA, 2293 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataatccaagaggttatccctaggggccctagcaaaggaagaggcggtgagcaggctgcagacg

SEQ ID NO: 434762 - DNA, 1470 bp, Homo sapiens
ttgcacatgcccaccaccaacagagagagcagcatactcgcttgcagaactgaacttagaagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434763 - DNA, 2392 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagtaaggatttatttttatttatttattttgataagcagatagacttttttggtacattatgaagtactcattctgtttttttgtctggggcggtatggtcagggacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagtatgctatacatcttttcaatccctttctaatgcattctactacttaatttttac

SEQ ID NO: 434764 - DNA, 1787 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagaggtttgtttttctatgtcagttctttacgatactgaattccagcattcaataagatcactctacattaagggggtggcttcaagaacatgtacagtaattagtgtcttatgatcctgcctataatatttttgaccgtcataagtt

SEQ ID NO: 434765 - DNA, 444 bp, Homo sapiens
tttagttcgttttgaaaggctgcgacgagcaatggaacttcgaaggtaggaagagagtctgttttatacctgtctttaaatataggtaaatatttaacactagttgtaagccatatttctggaaattgtattcccacagaaaactgtttgccaccttaaagaagttacggtagcatctaatgatttcttaagtttgcatagcactttacaatttacaaagtgcttttccatctgttgtctccaactcaacagttctgtaaggctagttatgcccattatacaattgaaaaaaatggaggcccagagaggctaaatgactcttccaatggccacatggctaacaagtggcagagtcgggactcagacccaagtcttctgactccaagtccaatgctctttcctcaacaccaaagctgctgccataaaaaacatgacttcaaagga

SEQ ID NO: 434766 - DNA, 523 bp, Homo sapiens
ttgtttgtttgtttggtttattactgtgtattcaagcacttgaaagttacgtctacagattatactttctggtactgttttgaatagtatatcttagctaagagtacctgtgaactgagtgacgtaaaatacgtcatcaggtcagccttcttattgacagctctttgatatgaggaagaattggattatataaactagttttgaatagtgaaactaatccagtttgttatttatgtactcattgatagatatacctgttttctaaaatgtaccaaacttgtgccacatatctctctacatggactctggttctgattggaatagcctatttatttgttagtgttaggtatccctaaataatatcattaaattatccaccaattttaacttggctgattttgtactattactaaaatctagttttatgtgaattcattttacatttgattattctttgaatttcaggatggtgaggaagaagaaaatgagaaaggtatgtttgatgctagagcttaaaaattgc

SEQ ID NO: 434767 - DNA, 512 bp, Homo sapiens
tctgcaatatcatggcagcctaatagtctgagcataggactatgagtccagagtagttgtaatccaggctctgtcactatcccagtcttagaaaataataacgatttccttacatattatagtgggaatgatttcccaaggctggaaggaaataatgcctctctttgcagaattgcacctcagggttttaaggcacttagtctccatgcatattaagaatgctatttctaattccctttaggtgcttttgttttagtcgaatgattaaactaaacttgaccttcccaaatacttgccaacttttaccacccagtccttgttatttttaatgttgcagaacaatagctacagcctagattattgaaatcaaatttaggtgtcataggtttgtgttttgcctggtctttgcttatgatggtttcttagcaacaggattaaaacaaggttgcatgtatacttatcttatgttttcattttgccttggttggttcttcattctgtgttgtctgaag

SEQ ID NO: 434768 - DNA, 438 bp, Homo sapiens
caatgaaaaattttagacattgttttatataatttttttcccttaggttccaagagtccaggacatatggtaatactagaccaaactaaaggagatcattgtagaccatcaagaagaggaagatatgagaaagtaagtctctgatcaggatggttgtatactacttcagctgtttacaaaagaagataattctgtttttccataaccatctttgcgtacttgcatgctagcaaacccaagaaaaaggaaatgttactagtcatttgaactttttaaatgacctactaaacttgaaaaataaagccccaaaatattttaatttctagtgttcttctaatttttttctacagattcatggaagaagtaaggaaaaggagagagctagtctagataaaaaaagagataaagactacagaaggaaagagatcttgccttttg

SEQ ID NO: 434769 - DNA, 167 bp, Homo sapiens
tgctgagattataggtatgagccactgcgcccggccaagtgacttttcatatgctattcttttagcactatcctgaggagcgacatgtggttgaacgccatggacgggacacaagcggaccaaggaaagagtggcatggtccaccctctcaagggcctagctatcat

SEQ ID NO: 434770 - DNA, 965 bp, Homo sapiens
  misc_feature (886)..(886): n is a, c, g, or t
  misc_feature (888)..(888): n is a, c, g, or t
  misc_feature (890)..(890): n is a, c, g, or t
  misc_feature (893)..(893): n is a, c, g, or t
  misc_feature (900)..(900): n is a, c, g, or t
tacttggcagtacctcagggtaaaggtagcgaggcctgggtgttggagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaggccgaagatctgggagagaagntncnggnccggtgngagggccccccgggaatagggaaggtcggggcgggacaccaaggggaaaggggcccacccggggg

SEQ ID NO: 434771 - DNA, 4410 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434772 - DNA, 4440 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434773 - DNA, 4488 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434774 - DNA, 4386 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggaaattgaagctcaagaaggtgaagatgatacctttctaacagcccaagatggtgaggaagaagaaaatgagaaagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434775 - DNA, 3106 bp, Homo sapiens
tataaagcaaagctattgtatacccttttacttaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434776 - DNA, 4557 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434777 - DNA, 4980 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaagcttccctaactgtttatcaaagcaagtctaatttgatggctagttctcaactcatagctgttaacagtagcagggagtagaatttgcagtgatttttaatttttatgtatttgtagtttttactctccttatatttttcctatcgtttccaaattttctgccattagcacacttcttataatcacaaaaatgtaaccatatgtacaaattgtttttctggttcgaacctttcaggtaaaaggtgatccctctaagaaagaaatgaagaaagaaaatgatgaaaagagtagttcaagaagttctggagataaaaaaaatacgagtgatagaagtagcaagtaaggatttatttttatttatttattttgataagcagatagacttttttggtacattatgaagtactcattctgtttttttgtctggggcggtatggtcagggacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434778 - DNA, 2461 bp, Homo sapiens
gggacttagctggtatcacaggccctcggctgacatgtaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434779 - DNA, 2219 bp, Homo sapiens
tacttggcagtacctcagggtaaaggtagcgaggcctgggtgttggagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434780 - DNA, 2460 bp, Homo sapiens
gctgttctagatgaccccttcgacggtgctctggcgcatcgcaacatacgagatgatagaagtagtcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctgga

SEQ ID NO: 434781 - DNA, 2446 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagtaaggatttatttttatttatttattttgataagcagatagacttttttggtacattatgaagtactcattctgtttttttgtctggggcggtatggtcaggctttttcagactctgtgattttagccctaaaacttgctttacttgttgtaaagcgtctatagaatgagtttagctaaggagcttttaagtgtccctgaaagataacagtgaattaggtactagttaaaaatagaattagtagtgactttgttctagataactggtaataattctagctctgcaatatcatggcagcctaatagtctgagcataggactatgagtccagagtagttgtaatccaggctctgtcactatcccagtcttagaaaataata

SEQ ID NO: 434782 - DNA, 2237 bp, Homo sapiens
attctttggactaacagccctagaactgctttgaggtcttttgaatggaactcggggaacctagttcgttggtgcacaccggcgacaatttttcgattattcagcagaactgataaagtatttccttgagaggttcagcgcgcgcacgcgccccctcggtttgtgttgagtaacgcgcgcactatgtcattcagtgcccgcacatcgttgttgctcaagactcaagacgttgcaagaaaatggctaacgaagcgacgagagaacggcggcgcggcggacgttgctgcggtaggacgtgcccgacctcccagtccacacaagggagcgcaccgcccaagtggccgcggcccgctcgaccgagcgcgccgctgccggtccctgcgccaacgcgcacgcgcggccgtcatccgggtgctggcggctgctgcaggttgcgctagggtggcggaccgggggaggggccagcggctcattgtgcgcagcgctgcgcggcgccggcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaaaaggtgatccctctaagaaagaaatgtcaacgcccttgaggaaataatttaacctgtgtcccaacccccctcacaggtcctcttgaccaaggaaggcttagtgtgtcaaggtgtttacggaaaccttctgaccaaacagtggctgggcactaagcaatgctgattcagagatggacccctaggaagccagtcttgaaaataaaagcaagaatcacaaaacaaaacagaggcttcctttagtggcttcaagttataaacaaccaaacagacaaagg

SEQ ID NO: 434783 - DNA, 727 bp, Homo sapiens
gcacacaagcccacacaagcccgggccccgctcctctgaactcccgcgtgtgttctgactatggcaaagaaggtctttgccgcgtgcacggcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggtaaatctgccttgtgcatttttactccatgcagaagggaggggtggaagagtgacaacaatcacaagcctccccatccagtgtaacacaacccccaataatgtgaagactgcccatcttatggaaatgggttttaagaatctgaaaatag

SEQ ID NO: 434784 - DNA, 2327 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcatcgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaa

SEQ ID NO: 434785 - DNA, 2722 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcatcgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaaaaaaaaaaaaaaaaaaaaaaaaaaaacaaaaaaaaaaaaaaaaacaaaaaaaaaaaaaaaaaaaaaaaaaagaaggggggggggccgcccccaaaaaatgtactccccgaggcggaggccacataagcagcgacgccccacacatttttttgtgctgacaagaggagggcgcccacatctatgggggcgtaattataacaaaccgaccgagcgcggcgccgacctcttcatcaaaaaacatcctcatactaacagtggggaaacaacaactactacggtcggggcaaccatttattgtaggaaaagcccactaatactcggaacgagggagcaaacaaactctgaggacacaaccccccccaagagaattaaaagaacccccaccagagaggaaa

SEQ ID NO: 434786 - DNA, 2273 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagatgaaatactcagaattcagggcaggggtgtccgtctatggcatcgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaa

SEQ ID NO: 434787 - DNA, 2270 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcatcgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaatctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaa

SEQ ID NO: 434788 - DNA, 1983 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcatcgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaagggggggggggcaaaaatttccccgggggggcccagggttttgccgcttacccgacttttctttgtcccaatgtgggcctcctaaatgggaggcgccggatattttataaccaaagggaaagggcgcggggttctacccacctccccgcctcgcgcaacccctgcttctcttgggacctcgtggggcaggggaccctactttgtgtgggcgcagccatacttgggcacttacctcgcggagtttaacactcaagggagttttaccttcactgttcttgtgtcacc

SEQ ID NO: 434789 - DNA, 1459 bp, Homo sapiens
  misc_feature (27)..(27): n is a, c, g, or t
attgtccaggggattccctgaaggacntttaccaatttaaaggaaccccccccactttggtccatttttggcctgaaaatggatgttggtgattcccccactcaagggcccgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaa

SEQ ID NO: 434790 - DNA, 1627 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcatcgtcaaggattctgaagacatttacaatttaaagaaccccactttgttcatttttgctgaaaatgatgttgtgattccactcaaggacccctgcagctggttgtgaaagaaaatagacgctcaggacccgaaagtcactatgccagagggaaagttcagcttgggaactgcgcaatactgccttcctttccttcccaaacagacagctgcaatgtcacaaccctgtgttagagcctcgtccgtaagccaggatcccacaaccatggaaggccacacatctccccagatggcctccctcccaaagcgctcacacagaaattccttgtgagcagctagatctttcaggctatatccaccccctataaactagccctgaaacaagttttttggatctcacccctgacgatgtcaattaccaggtgatcctcacagagaggacaaagacaagaccagaaatcatccctgagacaaatgcataattgacttttcctgtgcttcctttcttcacgtgtaaaatgtagatttactgagactcagagcctcacaagaatgcgagcatctgcctcactgcgtccctcccccgtcttttccctcctgcttgcccttgcctttttaaatattgccgtgccccagaccccctttggaaaaagcacagctcacagatgtttctgtggcttgtggttgttttcgtgggctcgttctcaaccttggcgaaataaacctctgtggattgaca

SEQ ID NO: 434791 - DNA, 486 bp, Homo sapiens
gacggagtcttgctctgttgcccagagctggagtgcaatggcatgatcttggctcactgcaacctccacctcccgggttcaagccattctcctgcctcagctactcaggagtctgaggaggagaatcacttgaacctggaggcagaggttgcagtgagtcgaggttgcgctactgcactccagcctggacaacagagggagactctgtctcaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaa

SEQ ID NO: 434792 - DNA, 456 bp, Homo sapiens
gggtcggagctacaggaggactccaactccctgaaatctggagtgaagaacgccgcaatccagccaccattccaaggtaagccagaaatgaagtgggccgttgggttctttcttttctttctttcttttttttgagacaaggtctcgctccagcctggacaacagagggagactctgtctcaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaa

SEQ ID NO: 434793 - DNA, 290 bp, Homo sapiens
gcacacaagcccacacaagcccgggccccgctcctctgaactcccgcgtgtgttctgactatggcaaagaaggtctttgccgcgtgcacgggtgtttcgccatgcattttaaagacatagtggaaatcacaccgtatgcaaacttgcgttcgttttggccatttagcacggaggagcctttccaccatgccgttaaatactccttgtaactctcttcctgcagtgagacattctggttgtagcgtttttactaatataaaactattaaaaaactgagcatatttgcaact

SEQ ID NO: 434794 - DNA, 2610 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaa

SEQ ID NO: 434795 - DNA, 1123 bp, Homo sapiens
caaaaatatttcaaaccattctcacaactctatatgtgtctatgaccagataactggaagaccttctggttatggactatgcgtatacactctcccagatagttagaggcatatctaagaggttaacatatatgatcttatccaaaatgggtctcttggtgctagtgttttacatcagacttcactggctttcacgtatttccacaagtgccaaacatttctcatatccttgctgtattccatagagcagtgttcctgctacctggaacacttgattcttgaataactcctgtttacctttcagacaaaacctaaaggttaccacctcaaagaagtctttatagaagcctcatcatcttagacactctgtattgtttccttcatcgtatttacaacagacagatactgtgcacttactgcctcacttaacgacagggatacgttctgaaaggtgcatcattaggcggttttgttgtgtgaacatcacagagtgttacttacacaaacctaaatgatacagcctactaaacacctaggctatatgagcaatacagcctattgctcttaggcttcaaacttgtacgacatgtcactgtactgaatactgtaggcaattataacacagtggtaagtatattgtgtatctaaacaaacatagaaaaggtaatgcactgtactatgatgttacaacagctaggatgttgctatcaatagaaatttttcagcttcattttatttttatgggaccacctttgtatatgtggttcattgttggccgaaacaccattctgtggcacatgactatgtatttattcctcattattcctttaatattcatctcttccaggagggcatgtcatggacaatctctttttcttaccacaggtcttaggacctggcctagcacctggccaagaactactggcatacctccttttattgtgcttcaatttattgtgctttgcaaatactgaattttttacaagttgaagatttgtggcacctctgtaaccagcaagtctattggtgccattttttcaacatcatgtgcctgtttcctgtctcgctcatgtcacattttggtaattttcacaatattaaaaactttttcattattattaaa

SEQ ID NO: 434796 - DNA, 523 bp, Homo sapiens
tatataatcagtttttcttttatactgttacaaaatgcctttcaagcttctcttatattttcaaaagctatgaaacccatcaaaattataaggacttaaatttatgtaatttttttatttttggatacttaaattttctattaatttgctataagtcattgaaatgttataaataattttctcatatctactctttgttcattttatttcagcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtga

SEQ ID NO: 434797 - DNA, 638 bp, Homo sapiens
cagaggtaccttgatgttctaataagagagatagggtacatgctgtaaaatgaggcaagcatgtgctccacatgggagccatacacttgattgctgtgtttgctctcttgatttgtctgtctaccatatataaagtgtctgctacatcaatgtctgtgactgggttctggctacataagatgccatggacagaccattagagataacactgtcctgcagttttacccatgaggtaatctttaggaatgaattagatgttaataatatactgatatttgtgtctgttgggaaaaaaagataatgacggtaaatggcactagcagccatagcagttcattatggcttatcatttgctattgctgtaagccaaagtaatatgttaaaccacctcattttaaattatgtcttaacttcaagcacagtggtttccctgtttgttttacagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtga

SEQ ID NO: 434798 - DNA, 3624 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434799 - DNA, 3158 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagtaagtgggaccagaagcatgcaccaccacatcccagctaatttttgtatttttttgtagagatggggttttgccatgtccaggctagtctcaaactcctggcagattcaagcagtctgtccgcctcagcatcccaaagtgctgggattacaggcacaggcatgagccaccatacccggccttccagttctttttaatgcagtatcctttatcatattcataggtcaaaagagaaaaatcagaatatttttaatagatgccagaaagacatttaataaagttaaatccactcctgatttttaaaatgacaacaataaaaacccatggcaaaattaaagtagaataatattgtatgcatacatatatatgttcatatgtgtctgttttttgtg

SEQ ID NO: 434800 - DNA, 1184 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtga

SEQ ID NO: 434801 - DNA, 2050 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434802 - DNA, 1863 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434803 - DNA, 4186 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaaggtatggttctataattttaggatgtttttcgcatctggcagtttattattagtagtacactggaattgtcaaactgactccttttccttaaagcagaatgttctcatagcataggaacaaattctgccatttcagtgagctctgcaaattttaagggaaagaaaaataccaagggaagaataatgtaagggagaaaaagatgtgttggaagccatatcttttgataaaaatttgcaatttacatactgtgaaagaaaagtctagaataacaatggtcctcactgagttgaattaagatatgtgaccttttcatcttgttttttaaacttaattcacctttactaagatctgttaggaaaacatattttgttttttattacagattgcctttagtttgacatgaagtcttttcatttttttcaccttaattatttaccttatctttaaaagaagttggtatttgagccttaaatgttaaaatatgattactggctatttatattatgaaactcctttttttacatttatctaagattaatattagtcactttctattttgtagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434804 - DNA, 1553 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaaggagggcatgtcatggacaatctctttttcttaccacaggtcttaggacctggcctagcacctggccaagaactactggcatacctccttttattgtgcttcaatttattgtgctttgcaaatactgaattttttacaagttgaagatttgtggcacctctgtaaccagcaagtctattggtgccattttttcaacatcatgtgcctgtttcctgtctcgctcatgtcacattttggtaattttcacaatattaaaaactttttcattattattaaa

SEQ ID NO: 434805 - DNA, 1746 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaaggtatggttctataattttaggatgtttttcgcatctggcagtttattattagtagtacactggaattgtcaaactgactccttttccttaaagcagaatgttctcatagcataggaacaaattctgccatttcagtgagctctgcaaattttaagggaaagaaaaataccaagggaagaataatgtaagggagaaaaagatgtgttggaagccatatcttttgataaaaatttgcaatttacatactgtgaaagaaaagtctagaataacaatggtcctcactgagttgaattaagatatgtgaccttttcatcttgttttttaaacttaattcacctttactaagatctgttaggaaaacatattttgttttttattacagattgcctttagtttgacatgaagtcttttcatttttttcaccttaattatttaccttatctttaaaagaagttggtatttgagccttaaatgttaaaatatgattactggctatttatattatgaaactcctttttttacatttatctaagattaatattagtcactttctattttgtagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtga

SEQ ID NO: 434806 - DNA, 4133 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttattgtctatagccctgctatcaaagactccacaatgagaaggtatacaatttccagtgccctcaatttgatgcaaatctgcaaaggaaaggtatggttctataattttaggatgtttttcgcatctggcagtttattattagtagtacactggaattgtcaaactgactccttttccttaaagcagaatgttctcatagcataggaacaaattctgccatttcagtgagctctgcaaattttaagggaaagaaaaataccaagggaagaataatgtaagggagaaaaagatgtgttggaagccatatcttttgataaaaatttgcaatttacatactgtgaaagaaaagtctagaataacaatggtcctcactgagttgaattaagatatgtgaccttttcatcttgttttttaaacttaattcacctttactaagatctgttaggaaaacatattttgttttttattacagattgcctttagtttgacatgaagtcttttcatttttttcaccttaattatttaccttatctttaaaagaagttggtatttgagccttaaatgttaaaatatgattactggctatttatattatgaaactcctttttttacatttatctaagattaatattagtcactttctattttgtagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434807 - DNA, 2920 bp, Homo sapiens
gttctctttatttcctgtgaaggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434808 - DNA, 3637 bp, Homo sapiens
  misc_feature (1)..(1): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccgtgagttgccccggcttcgcgcctggccaacctcatgccacccagaccatcgggccacactccggattggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttattgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434809 - DNA, 1139 bp, Homo sapiens
  misc_feature (1)..(1): n is a, c, g, or t
  misc_feature (1023)..(1023): n is a, c, g, or t
ncacacacaaacgccttcttcccggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaaggtatggttctataattttaggatgtttttcgcatctggcagtttattattagtagtacactggaattgtcaaactgactccttttccttaaagcagaatgttctcatagcataggaacaaattctgccatttcagtgagctctgcaaattttaagggaggaaaatcccaggagatatgtnggagaaagagtttggagcatttttgataaattgacttcttgggaaaagttaaaaaaggtgccgggtggattgccgtcgtggttaagatacttagatgtgaattgtgttgggttggt

SEQ ID NO: 434810 - DNA, 3796 bp, Homo sapiens
ttttcgtatattcttcctagatacaatattgtctcgatccatctcacgcaatgtttgaattcacacagtgtaatatgtctgttccacttactcatggcacatgtgtagtgataccacaattaaagaatcccttggcaactgttactcattgaactcacgtgcaccagacttaagagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaaggtatggttctataattttaggatgtttttcgcatctggcagtttattattagtagtacactggaattgtcaaactgactccttttccttaaagcagaatgttctcatagcataggaacaaattctgccatttcagtgagctctgcaaattttaagggaaagaaaaataccaagggaagaataatgtaagggagaaaaagatgtgttggaagccatatcttttgataaaaatttgcaatttacatactgtgaaagaaaagtctagaataacaatggtcctcactgagttgaattaagatatgtgaccttttcatcttgttttttaaacttaattcacctttactaagatctgttaggaaaacatattttgttttttattacagattgcctttagtttgacatgaagtcttttcatttttttcaccttaattatttaccttatctttaaaagaagttggtatttgagccttaaatgttaaaatatgattactggctatttatattatgaaactcctttttttacatttatctaagattaatattagtcactttctattttgtagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434811 - DNA, 2963 bp, Homo sapiens
tatataatcagtttttcttttatactgttacaaaatgcctttcaagcttctcttatattttcaaaagctatgaaacccatcaaaattataaggacttaaatttatgtaatttttttatttttggatacttaaattttctattaatttgctataagtcattgaaatgttataaataattttctcatatctactctttgttcattttatttcagcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434812 - DNA, 3078 bp, Homo sapiens
cagaggtaccttgatgttctaataagagagatagggtacatgctgtaaaatgaggcaagcatgtgctccacatgggagccatacacttgattgctgtgtttgctctcttgatttgtctgtctaccatatataaagtgtctgctacatcaatgtctgtgactgggttctggctacataagatgccatggacagaccattagagataacactgtcctgcagttttacccatgaggtaatctttaggaatgaattagatgttaataatatactgatatttgtgtctgttgggaaaaaaagataatgacggtaaatggcactagcagccatagcagttcattatggcttatcatttgctattgctgtaagccaaagtaatatgttaaaccacctcattttaaattatgtcttaacttcaagcacagtggtttccctgtttgttttacagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434813 - DNA, 2882 bp, Homo sapiens
tagagttaaatgagtcttttctcagatgcatgttccagttggactaagaactgctgttgaattaattagcctctcaagatgaccaggttagctggcactttctgttatgtttgtgttagtctcgtgtccttgggtgactctgggttgaaatctttaatgctcccccaagaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagtgcatcatgaccaggtgaaatttattctttttttcttcttctttttgagacagggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434814 - DNA, 1446 bp, Homo sapiens
atggcaaaaccccgtctctactaaaaatacaaaatcagccaggcatggtggcccatgactgtaatccctgctactcgggaggctgaggcaggaaaattgcttgaacccgggaggtagaggttgcactgagctgagatcgcaccactgcattccagtctgggcgacagaatgagactctgtctaaaaaaaagaaagtaccaactattttattatttattacttcattatattaatttaaatattgaagtgtcagctatcatttaggaaaaaactaagtcaaatctctatctcacacccaatacacacccatagtaaatccaggtagattaaagatttaaattttttaacaaacttgtaaaatactagaggaaaatgtaagttaattaaaaaaataataatcttggattgcaatagacctgccgagcatggtcatcaaagccagaaaacaaagtttgattgatttgtctctacataacaacaagtaggaaagtacatttacaatacatattccaggaaggtttcatatgcttagcttttaagaattttttttttttaaatacccaacatgacatgctgttagcatccatagagatccccattcccagggtggtgtacctatattgccagtgcttcagatgttgggtactaatgacttatcttcacccttttccagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagaaaaaaaaaaa

SEQ ID NO: 434815 - DNA, 4375 bp, Homo sapiens
gagctggaattcccttcccgcctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcaactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgtgtgtgtgtgtgtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 434816 - DNA, 4018 bp, Homo sapiens
agcggcggagccggcgcgccccgggcgggcggagaggctgcggggacgcgcgccctccgcctcccgcagctgcgcgtccgcagccgaggcgcccgggcccgcagcttcccgggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgtgtgtgtgtgtgtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 434817 - DNA, 4478 bp, Homo sapiens
gagctggaattcccttcccgcctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcaactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagacagcctctggagatcctgtgttgctacttgtcatgtttcttaggatcagctatcaagaataatctacttgctgcccagcctggcttctgtattaagtagtcgaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgtgtgtgtgtgtgtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 434818 - DNA, 4770 bp, Homo sapiens
gatgtgtatatttatgtatttaaggagaggcaagacaaagagaagtgaccttttttttttcccactccaagttttcattatttgtcgagctattcccaatgtccctctctggtgactctccactgaagatagttttcaactttttctttacatataattgaaaaagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggcactgtaacccaaagagtactttactggtagatttcctagtttttccatgaccctggctgagcaaatgttctttagatttgacctagaaaacccttcttgtgtgttttgtaacctcacaagccactgctaatgtaccttcttcacttgggccacccaccgtgatttctgtcctggattccctgagccaaatacccatgatgggatggttcagtgatgtggatggatggctatttgtgtaagggccgaaaactagttttctaagatgggagagctgggcagttacttatactctgaagcccttctctttctctgctggggctttcccagcagttcctaatagttccttgtatttcagataagtcatcatgattgttaggaaaaaaagaaaagaaaaagttagtttttagcctcctgacttcttaagtcaagtgagacttctaaaatttagtaaataatagctcattatttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagtggtgttagtggaggcggtgtcatcacttgtctttctttctttcagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgtgtgtgtgtgtgtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 434819 - DNA, 3586 bp, Homo sapiens
attctcgggagccttaaacctggggtgatgtgtgtgccttcccctcttacccttgtgcctgcccctgaaagaaagtgtggagttcagtgtatacacattgtctttggttgctggactaaggctgaacaagattaataacttgttgtattgaactgcttatcttcgatagctagtgtttggacagtgtgccattcccgtggaatcttggggacaggagtgagattcgagaagccatcctttcctcctctgtcctcaggcggaatggcccccaactgggagagcgaattttcttcagatgttcaggagagtctagtagttcatgccattgttacacttttcatcgatcagaagaactaactctgtgggcctttgtgtctctctttcaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgtgtgtgtgtgtgtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 434820 - DNA, 3325 bp, Homo sapiens
tacactgacctggtggttcaaaggtgtggggataccagggaggaggggctgtgtgaaagtcagagctgcgctttttcctggttttatccagtctgagtctcccacggaagagacgtttgggagtgggaggtgagtgcggatggatctaaatatatctcttcccagccactttgaaaactgtttttctaacttgtgctttttctgaaagagttttttctctttgttaccaaattatgcaggcagaggtagacatttctgtacagacttgcctagtggtgttagtggaggcggtgtcatcacttgtctttctttctttcagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgtgtgtgtgtgtgtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 434821 - DNA, 2490 bp, Homo sapiens
gagctggaattcccttcccgcctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcaactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagcctgggcgacagtgcaagactctgtctccaaaa

SEQ ID NO: 434822 - DNA, 2344 bp, Homo sapiens
gatgtgtatatttatgtatttaaggagaggcaagacaaagagaagtgaccttttttttttcccactccaagttttcattatttgtcgagctattcccaatgtccctctctggtgactctccactgaagatagttttcaactttttctttacatataattgaaaaagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggcactgtaacccaaagagtactttactggtagatttcctagtttttccatgaccctggctgagcaaatgttctttagatttgacctagaaaacccttcttgtgtgttttgtaacctcacaagccactgctaatgtaccttcttcacttgggccacccaccgtgatttctgtcctggattccctgagccaaatacccatgatgggatggttcagtgatgtggatggatggctatttgtgtaagggccgaaaactagttttctaagatgggagagctgggcagttacttatactctgaagcccttctctttctctgctggggctttcccagcagttcctaatagttccttgtatttcagataagtcatcatgattgttaggaaaaaaagaaaagaaaaagttagtttttagcctcctgacttcttaagtcaagtgagacttctaaaatttagtaaataatagctcattatttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagtggtgttagtggaggcggtgtcatcacttgtctttctttctttcagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtaaaaaacaaaccaaacagttctcaccatgattgtgaatggtaacttggggggggcccggtaccaaattccccttatagggagggtttaaaaataccggcccgagttttcaacg

SEQ ID NO: 434823 - DNA, 1871 bp, Homo sapiens
gatgtgtatatttatgtatttaaggagaggcaagacaaagagaagtgaccttttttttttcccactccaagttttcattatttgtcgagctattcccaatgtccctctctggtgactctccactgaagatagttttcaactttttctttacatataattgaaaaagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggcactgtaacccaaagagtactttactggtagatttcctagtttttccatgaccctggctgagcaaatgttctttagatttgacctagaaaacccttcttgtgtgttttgtaacctcacaagccactgctaatgtaccttcttcacttgggccacccaccgtgatttctgtcctggattccctgagccaaatacccatgatgggatggttcagtgatgtggatggatggctatttgtgtaagggccgaaaactagttttctaagatgggagagctgggcagttacttatactctgaagcccttctctttctctgctggggctttcccagcagttcctaatagttccttgtatttcagataagtcatcatgattgttaggaaaaaaagaaaagaaaaagttagtttttagcctcctgacttcttaagtcaagtgagacttctaaaatttagtaaataatagctcattatttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagaggagaaaagaaaaagagaacaattaaaaacaagaaaaacaaaactagatattctaaatttcacaagcgtttttcaaaaagagacgaggccatatttttccttaaagaaaattactttttttttgacagagtgagacccagtctctaaaataa

SEQ ID NO: 434824 - DNA, 2321 bp, Homo sapiens
gatgtgtatatttatgtatttaaggagaggcaagacaaagagaagtgaccttttttttttcccactccaagttttcattatttgtcgagctattcccaatgtccctctctggtgactctccactgaagatagttttcaactttttctttacatataattgaaaaagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggcactgtaacccaaagagtactttactggtagatttcctagtttttccatgaccctggctgagcaaatgttctttagatttgacctagaaaacccttcttgtgtgttttgtaacctcacaagccactgctaatgtaccttcttcacttgggccacccaccgtgatttctgtcctggattccctgagccaaatacccatgatgggatggttcagtgatgtggatggatggctatttgtgtaagggccgaaaactagttttctaagatgggagagctgggcagttacttatactctgaagcccttctctttctctgctggggctttcccagcagttcctaatagttccttgtatttcagataagtcatcatgattgttaggaaaaaaagaaaagaaaaagttagtttttagcctcctgacttcttaagtcaagtgagacttctaaaatttagtaaataatagctcattatttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagaggagaaaagaaaaagagaacaattaaaaacaagaaaaacaaaactagatattctaaatttcacaagcgtttttcaaaaagagacgaggccatatttttccttaaagaaaattacttttttttttgagagaacaggatctcactctgtcaccctggctggaatgcagtgacatgatcacagctcactgcagcctcaccctaccatgctaaagtgatcctcccacctcagccttccaagtagcagctggtaccataggtgcacaccaccatgcctggctaattttttattttttttagagacaggaggtctcaccatattgcccaggctggtctcgaacccctaggctcaagtgatcctcctgcttcagcccacccaaagagttgggattacaggcatgagacaccatgcttggccgaaaatcattattaattaaaaatgtcagagcaaccttttatctagacgttgatcttatctacgctacaactgtcatcttgtgagggacatgggaaatgggaaaagggagaggggaggacctttgttagtgtctctctggtgatataatggggaaactaaggctaggcatggtaaagatcctgtcttta

SEQ ID NO: 434825 - DNA, 1462 bp, Homo sapiens
gagctggaattcccttcccgcctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcaactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagaggtaagtgaagggaccaggtaggtggtctgcccatgtgtaggcgtcagcagtctgggaagggcaagagggtgtcagaggaagccccgacatatc

SEQ ID NO: 434826 - DNA, 2182 bp, Homo sapiens
gatgtgtatatttatgtatttaaggagaggcaagacaaagagaagtgaccttttttttttcccactccaagttttcattatttgtcgagctattcccaatgtccctctctggtgactctccactgaagatagttttcaactttttctttacatataattgaaaaagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggcactgtaacccaaagagtactttactggtagatttcctagtttttccatgaccctggctgagcaaatgttctttagatttgacctagaaaacccttcttgtgtgttttgtaacctcacaagccactgctaatgtaccttcttcacttgggccacccaccgtgatttctgtcctggattccctgagccaaatacccatgatgggatggttcagtgatgtggatggatggctatttgtgtaagggccgaaaactagttttctaagatgggagagctgggcagttacttatactctgaagcccttctctttctctgctggggctttcccagcagttcctaatagttccttgtatttcagataagtcatcatgattgttaggaaaaaaagaaaagaaaaagttagtttttagcctcctgacttcttaagtcaagtgagacttctaaaatttagtaaataatagctcattatttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagaggagaaaagaaaaagagaacaattaaaaacaagaaaaacaaaactagatattctaaatttcacaagcgtttttcaaaaagagacgaggccatatttttccttaaagaaaattacttttttttttgagagaacaggatctcactctgtcaccctggctggaatgcagtgacatgatcacagctcactgcagcctcaccctaccatgctcaagtgatcctcctgcttcagcccacccaaagagttgggattacaggcatgagacaccatgcttggccgaaaatcattattaattaaaaatgtcagagcaaccttttatctagacgttgatcttatctacgctacaactgtcatcttgtgagggacatgggaaatgggaaaagggagaggggaggacctttgttagtgtctctctggtgatataatggggaaactaaggctaggcatggtaaagatcctgtcttta

SEQ ID NO: 434827 - DNA, 438 bp, Homo sapiens
cccactccaagttttcattatttgtcgagctattcccaatgtccctctctggtgactctccactgaagatagttttcaactttttctttacatataattgaaaaaaaaaaaaagaaacttagtagtcattgctttgaccttcaacactggttgtcaggttacagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggca

SEQ ID NO: 434828 - DNA, 381 bp, Homo sapiens
ctttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgcca

SEQ ID NO: 434829 - DNA, 702 bp, Homo sapiens
ctcccatgcaaacagacagtgagtggaggacaccagcaaagtaataaggaatgtttcaaaaggatatgatgaactgaggcttatcgagtcagggagcagaaagctgaaataagaccgctaagctctaaacaaatccgttaaagcttcacagggcagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctatgactagacattcactttgcaaataattgttgtgactctatgtttgctccagacacagagcttttattgtcacccaaagatgcctatgggaaccaaaagaatcaagctgaaccaagatttctgccagaatcaatttcctcaagccagaaggctttatcattcagtctgtgcaacggatttttttttaaataaaaacagacttctttgttgatttctccctttacc

SEQ ID NO: 434830 - DNA, 4447 bp, Homo sapiens
cccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagtattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434831 - DNA, 4550 bp, Homo sapiens
  misc_feature (670)..(670): n is a, c, g, or t
aaataatgaattacaaagtcttttaagtgattatagttaaagctcttcatggttttgtacttatctttcttaaagggtaagggccaaagctgatcattttctatctttctaaagatttaaaatagttgttggtgtacaactaataccgatttagtacagactgagttcatgagtgattactgcaggtgctgatagaaagcagagcttaattgtacaaataataactttttttgttttgacattcatatcacaaagaaatctaataatttcaggttataagtgcttgaaaattatatgttctttttttagtatcaaacttatttttttttcagttggtgcaatttgtgtgcacattcttgacttgtgctttttaaaatttagtttaagccttccttggtggtttgctgcttatttttcctggatagctgcctccttgttctgtattcacagatttatgcttctccatagtgtcacctttccatcagtcaaccagcctaggtacaacagcagcacctcccttagacgtagcagatagtcactaagcacctacactgcgcactctagggatggaggagagagtagtagacagaaaagtcaaaagccagtgtttataagccctcaagaaacttgaaatctagctctgtagacatgtggagaaagatcaagagancaaagtgttgttatggagtgtggactatttggatgtggaaaaaattagccagccttgaggttcccaatcagtatgttgtattatgttagaaaggcactactttctacctttctgaccccttcaggctggcacaggaaaggaggctggttggaagcctttaatcttgagtcttatcccacacaacctaatagaaagtgtcacccagggcaggttttccaagtgtggggttcctgctggtcacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagaaaagagcttcctacattgtgttccacttatatgaggctgatggtagaatccttttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434832 - DNA, 4348 bp, Homo sapiens
  misc_feature (915)..(915): n is a, c, g, or t
  misc_feature (926)..(926): n is a, c, g, or t
  misc_feature (933)..(933): n is a, c, g, or t
  misc_feature (946)..(946): n is a, c, g, or t
  misc_feature (949)..(949): n is a, c, g, or t
  misc_feature (951)..(951): n is a, c, g, or t
  misc_feature (960)..(960): n is a, c, g, or t
  misc_feature (962)..(962): n is a, c, g, or t
cccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagttagtgaatgnggggggtctanctaaacncagacacattaanaancnccatttgancntggaagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434833 - DNA, 4496 bp, Homo sapiens
  misc_feature (670)..(670): n is a, c, g, or t
aaataatgaattacaaagtcttttaagtgattatagttaaagctcttcatggttttgtacttatctttcttaaagggtaagggccaaagctgatcattttctatctttctaaagatttaaaatagttgttggtgtacaactaataccgatttagtacagactgagttcatgagtgattactgcaggtgctgatagaaagcagagcttaattgtacaaataataactttttttgttttgacattcatatcacaaagaaatctaataatttcaggttataagtgcttgaaaattatatgttctttttttagtatcaaacttatttttttttcagttggtgcaatttgtgtgcacattcttgacttgtgctttttaaaatttagtttaagccttccttggtggtttgctgcttatttttcctggatagctgcctccttgttctgtattcacagatttatgcttctccatagtgtcacctttccatcagtcaaccagcctaggtacaacagcagcacctcccttagacgtagcagatagtcactaagcacctacactgcgcactctagggatggaggagagagtagtagacagaaaagtcaaaagccagtgtttataagccctcaagaaacttgaaatctagctctgtagacatgtggagaaagatcaagagancaaagtgttgttatggagtgtggactatttggatgtggaaaaaattagccagccttgaggttcccaatcagtatgttgtattatgttagaaaggcactactttctacctttctgaccccttcaggctggcacaggaaaggaggctggttggaagcctttaatcttgagtcttatcccacacaacctaatagaaagtgtcacccagggcaggttttccaagtgtggggttcctgctggtcacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434834 - DNA, 4177 bp, Homo sapiens
tagttgatccattaacatttcatttgctgtttaccctaagagtcagtaatttttagctaaaggaaaatcttatgcctgtatgactactgtccaaaattctgaaaatgttatatacctcatggctcagagataaatcagatatgtcaaatcagtcatagacatttacatatggtgattcctttttcaactttaaaaagtcacgcattcacctaattgactttggataatagggctataccttgaagtcactgactctagaaatgagcatgtggatggtatgtggaaagtcaaccatgtgctaaattttagatacttgagaatcttattatttagaagaattttttggtacttgaatttatgtctataagtattaactgtgtatactatgttatttttctctactcagggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagtattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434835 - DNA, 3141 bp, Homo sapiens
ctcccatgcaaacagacagtgagtggaggacaccagcaaagtaataaggaatgtttcaaaaggatatgatgaactgaggcttatcgagtcagggagcagaaagctgaaataagaccgctaagctctaaacaaatccgttaaagcttcacagggcagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434836 - DNA, 4470 bp, Homo sapiens
  misc_feature (670)..(670): n is a, c, g, or t
aaataatgaattacaaagtcttttaagtgattatagttaaagctcttcatggttttgtacttatctttcttaaagggtaagggccaaagctgatcattttctatctttctaaagatttaaaatagttgttggtgtacaactaataccgatttagtacagactgagttcatgagtgattactgcaggtgctgatagaaagcagagcttaattgtacaaataataactttttttgttttgacattcatatcacaaagaaatctaataatttcaggttataagtgcttgaaaattatatgttctttttttagtatcaaacttatttttttttcagttggtgcaatttgtgtgcacattcttgacttgtgctttttaaaatttagtttaagccttccttggtggtttgctgcttatttttcctggatagctgcctccttgttctgtattcacagatttatgcttctccatagtgtcacctttccatcagtcaaccagcctaggtacaacagcagcacctcccttagacgtagcagatagtcactaagcacctacactgcgcactctagggatggaggagagagtagtagacagaaaagtcaaaagccagtgtttataagccctcaagaaacttgaaatctagctctgtagacatgtggagaaagatcaagagancaaagtgttgttatggagtgtggactatttggatgtggaaaaaattagccagccttgaggttcccaatcagtatgttgtattatgttagaaaggcactactttctacctttctgaccccttcaggctggcacaggaaaggaggctggttggaagcctttaatcttgagtcttatcccacacaacctaatagaaagtgtcacccagggcaggttttccaagtgtggggttcctgctggtcacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagaaaagagcttcctacattgtgttccacttatatgaggctgatggtagaatccttttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaataaaaaaagtgtt

SEQ ID NO: 434837 - DNA, 2111 bp, Homo sapiens
  misc_feature (670)..(670): n is a, c, g, or t
aaataatgaattacaaagtcttttaagtgattatagttaaagctcttcatggttttgtacttatctttcttaaagggtaagggccaaagctgatcattttctatctttctaaagatttaaaatagttgttggtgtacaactaataccgatttagtacagactgagttcatgagtgattactgcaggtgctgatagaaagcagagcttaattgtacaaataataactttttttgttttgacattcatatcacaaagaaatctaataatttcaggttataagtgcttgaaaattatatgttctttttttagtatcaaacttatttttttttcagttggtgcaatttgtgtgcacattcttgacttgtgctttttaaaatttagtttaagccttccttggtggtttgctgcttatttttcctggatagctgcctccttgttctgtattcacagatttatgcttctccatagtgtcacctttccatcagtcaaccagcctaggtacaacagcagcacctcccttagacgtagcagatagtcactaagcacctacactgcgcactctagggatggaggagagagtagtagacagaaaagtcaaaagccagtgtttataagccctcaagaaacttgaaatctagctctgtagacatgtggagaaagatcaagagancaaagtgttgttatggagtgtggactatttggatgtggaaaaaattagccagccttgaggttcccaatcagtatgttgtattatgttagaaaggcactactttctacctttctgaccccttcaggctggcacaggaaaggaggctggttggaagcctttaatcttgagtcttatcccacacaacctaatagaaagtgtcacccagggcaggttttccaagtgtggggttcctgctggtcacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagaaaagagcttcctacattgtgttccacttatatgaggctgatggtagaatccttttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctatgactagacattcactttgcaaataattgttgtgactctatgtttgctccagacacagagcttttattgtcacccaaagatgcctatgggaaccaaaagaatcaagctgaaccaagatttctgccagaatcaatttcctcaagccagaaggctttatcattcagtctgtgcaacggatttttttttaaataaaaacagacttctttgttgatttctccctttacc

SEQ ID NO: 434838 - DNA, 2170 bp, Homo sapiens
  misc_feature (670)..(670): n is a, c, g, or t
aaataatgaattacaaagtcttttaagtgattatagttaaagctcttcatggttttgtacttatctttcttaaagggtaagggccaaagctgatcattttctatctttctaaagatttaaaatagttgttggtgtacaactaataccgatttagtacagactgagttcatgagtgattactgcaggtgctgatagaaagcagagcttaattgtacaaataataactttttttgttttgacattcatatcacaaagaaatctaataatttcaggttataagtgcttgaaaattatatgttctttttttagtatcaaacttatttttttttcagttggtgcaatttgtgtgcacattcttgacttgtgctttttaaaatttagtttaagccttccttggtggtttgctgcttatttttcctggatagctgcctccttgttctgtattcacagatttatgcttctccatagtgtcacctttccatcagtcaaccagcctaggtacaacagcagcacctcccttagacgtagcagatagtcactaagcacctacactgcgcactctagggatggaggagagagtagtagacagaaaagtcaaaagccagtgtttataagccctcaagaaacttgaaatctagctctgtagacatgtggagaaagatcaagagancaaagtgttgttatggagtgtggactatttggatgtggaaaaaattagccagccttgaggttcccaatcagtatgttgtattatgttagaaaggcactactttctacctttctgaccccttcaggctggcacaggaaaggaggctggttggaagcctttaatcttgagtcttatcccacacaacctaatagaaagtgtcacccagggcaggttttccaagtgtggggttcctgctggtcacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagaaaagagcttcctacattgtgttccacttatatgaggctgatggtagaatccttttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttatagatgactagacattcactttgcaaataattgttgtgactctatgtttgctccagacacagagcttttattgtcacccaaagatgcctatgggaaccaaaagaatcaagctgaaccaagatttctgccagaatcaatttcctcaagccagaaggctttatcattcagtctgtgcaacggatttttttttaaataaaaacagacttctttgttgatttctccctttacc

SEQ ID NO: 434839 - DNA, 391 bp, Homo sapiens
tttacatgatcttaagccacatgtgtctctgtcagtaatatttgtcacatgctagttttgctgtttatggaataaagtccagtagtttgttttacaacacaccgtttaaattatttgttaaaaataattttatttataaatagcaatttttacttggaatgtcttagtaaatttagcaagtatactatactacaaattttttttttcagtgtacccgtgtaatgtggacaccacctctccgtgaaagcttctcatatccatttcttgttcttcagatgttgctagtgactcatattctcaggtaactttgacttaaccttatttctttttgcattaaataattttaactaaaatttcttaagcttccataataaagtgaacataataaaat

SEQ ID NO: 434840 - DNA, 473 bp, Homo sapiens
agtgtgagatggagaatgggctgttttatagtcccttttcaacagtttgaattttgtttattatgggcatgtgcagttttcacaataaaaaacaaaggttttttgttttatgtgcattacttatatttttttcttggatttttccagatttctcttgcactttgttttgttttgatgtttgggaactcaatgttattaacttcttattatgcttcttctttggtaattatttgggtaagtattccttaacacttatatggctgtttttgaaactaatggtttaacaattttttcttcactggcttaggattcatcagggttttctgtaggaaccatcttaagtgtcttactgaatattctagatgtatggtgttcaagtactcaattctaaaacagggaaaaaaaaaacaaggaaaaattagtatcatttcagaaaagtttctatgctttcttctcccttcctcctttgcatt

SEQ ID NO: 434841 - DNA, 2432 bp, Homo sapiens
acgcacgccttgccccgccccttccggaggctcgccgtacgcatgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggt

SEQ ID NO: 434842 - DNA, 439 bp, Homo sapiens
attgggcacgagggggcttttgcaagaattattgaacaagatgctgtagtctcagagaggggaaaaaattaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttaggtaggatgagatttccccaccccactcctcctcactccagagaaaatataagaaataaaaccttgataatttacacc

SEQ ID NO: 434843 - DNA, 4241 bp, Homo sapiens
acgcacgccttgccccgccccttccggaggctcgccgtacgcatgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaagctttgtgt

SEQ ID NO: 434844 - DNA, 4581 bp, Homo sapiens
acgcacgccttgccccgccccttccggaggctcgccgtacgcatgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaaaaaaaaaaaaaaaaaaaaaaaaaaaaatgttgggggggctgggccgaggaaaggtttttaaaaacccacttgcgtgtgtggcgggggggggcccaaggttggtgtacgtgggcgacacttgcggtacataacggtggtccccaaagaggagaacctccgggcgcatggcacatcatcggtgcgcgtgtgggttctccccccatataaaaaaaagcgccgggcggggaaacaccgagacgttgtccttggacgcaaatctcacaggatggaggggtcagagggggcctatcagcggggagttccttatccaacagggggaggtcaaagggggaggggcagaaaattaaaatagcccgggacaagggggggggagcgg

SEQ ID NO: 434845 - DNA, 4219 bp, Homo sapiens
acgcacgccttgccccgccccttccggaggctcgccgtacgcatgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaagctttgtgt

SEQ ID NO: 434846 - DNA, 4362 bp, Homo sapiens
acgcacgccttgccccgccccttccggaggctcgccgtacgcatgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagtgctcttgctgctcccctcattggtggtccacatggaagtacctggtgcgatacaaaggcaaagaaatactttagttaagaatatttacagcctgtaatcccagcacgttgggaggccaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaagctttgtgt

SEQ ID NO: 434847 - DNA, 3097 bp, Homo sapiens
tctagcggaccccctgatatgtctggatcattacaacagctgacgacagaaacagagtgtctggattactaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaagctttgtgt

SEQ ID NO: 434848 - DNA, 2892 bp, Homo sapiens
gttttgggtggtaagccttaagaaaaagtcactgacaaaaagtcgaccacccatgagggaaatacttggaatgagttagagacaaaaagacattttgaattttttattttctacttgctaatatgataaactgaaataagtcttctctcttgtattttttagtactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaagctttgtgt

SEQ ID NO: 434849 - DNA, 1224 bp, Homo sapiens
ctaccttggcctcccaaattgttgagattataggcatgagccaccacgtccagccctcactacctttctttaccactactcttattctcggtcgtgttgatttcaatatctctgttccctgaccttccttcccccatgctcttgtgctccaccctacctcaggcatccattcctgtgagcataccctcaatttttgcattattaattactacaccaccttcaaaatctccatttcaggcatcccgttttcagaccccacctcgtctttctagctcattctctctagcacctggatccaacctaggcgacagagtgagactccgtctcaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaaaaaaaaaaaaaaaaaaaaaaaaaaaaatgttgggggggctgggccgaggaaaggtttttaaaaacccacttgcgtgtgtggcgggggggggcccaaggttggtgtacgtgggcgacacttgcggtacataacggtggtccccaaagaggagaacctccgggcgcatggcacatcatcggtgcgcgtgtgggttctccccccatataaaaaaaagcgccgggcggggaaacaccgagacgttgtccttggacgcaaatctcacaggatggaggggtcagagggggcctatcagcggggagttccttatccaacagggggaggtcaaagggggaggggcagaaaattaaaatagcccgggacaagggggggggagcgg

SEQ ID NO: 434850 - DNA, 5343 bp, Homo sapiens
  misc_feature (1363)..(1363): n is a, c, g, or t
  misc_feature (1561)..(1561): n is a, c, g, or t
  misc_feature (1742)..(1742): n is a, c, g, or t
  misc_feature (1990)..(1990): n is a, c, g, or t
  misc_feature (2235)..(2235): n is a, c, g, or t
  misc_feature (2370)..(2370): n is a, c, g, or t
  misc_feature (2407)..(2407): n is a, c, g, or t
  misc_feature (3178)..(3178): n is a, c, g, or t
cccctccttggccccaagcctggccagttgtgctaaaagtagcgctgacccaatcatggtctgtccagaggccaggactattttgactctgtcctcaggattcatgtggtctgaggcgtgtacgagctggactgctcccatgaccactcagatgtggtgccaggaatgttctggctgacacacctgtccccagagctgctaaacgctgctacttaccccacagccccacagcgtgcgtcctgagatactggttccaggagggataggtggtgaggacttgcaccaggcggtggttaggggctttctatcctcattcataagagagcaaccagccagttttgggtggcattgcttctcatagctccccactggactggagcatgttaatctgtgtatttgtgacattcactcagaatgggggcccgacaacagaaggctccttagagacagcaaacattattcttccaaggaaggctggaggatttccttctctggaggccgttaatagtggaagaacttttcatcctactggcttaaatataagtcccagtgcaaggctcctgcctggaacatcatcctcccctctactagattggctttgccattcttcaaagtccaactgaaatccccttccctaaggacttccttcttttgtcaccagaggggtacttagcacagacttcccattaatagagaggctttttcctcctttttttcttcccatctagtctgtgagttcttaacttcagatatctttcacttgccagcacccaggatgcggcagatgcccaacagttgtgggctggtgaaccagcacagccagcacggccactagctctgctcaagaaacaagtctgcgtctccttattgtgctagttcattcctcagttcactacacaatccttcaacgttggcctctttgcctgtctgcacactgtgcctggtctgcacactggaaataaacaatgtctaatgagatggggtccctgcctgagagaagctcatggcctagtgggggacacatgtcttgccatctagtgggcgaaaagcaatcattcagaggccacggtgaccagctttgcctcagggagtcgggaagggccttgcagaggctgtgatctgtggcaggccctcacagaagctcagaaaggcacgcgaggacaggcaggaggaagcgcgctccagaggagggccagcacgtgcgaaggcatggaggcatgaaaggcccttgcacctgggaaggccaaaaaatcaccatatttttgctgctttttgtctacagaccagctggctatggacagggaggctgcttggctctttcccacaaatagggaggttggagccaggcactagggcttgaccncagaaggtgtcagagctcccagagtccttgcctctctgccccctggggccatctgcaccctctcctcccatcctgcctccgctccttcccaattagaatgaaaattggctcctgtaatgctgatgtgcctactttcttgttagaatcttaataccgtatgaatcacaagtcccagctgccttggcatggtggtcaggntcagaggtttgaattaaagcaacacatggtcctgatggcttcatctgggggatgctgaggtaggggagaggctgctcctccttttccaccgataatgcgagtaccaccaaggctgctgaccgcagccttttccctcagaaagttctaagcaccttgtaacaccccctgataataagagtantcgtaccttttattgagcattttacaagtataatttcatttatttgtcagatgacttgctgatgtgtagttaggtgacgtgcctgagatttcatagctagtcataatagagccagattttgagacctcccatctcggggaccttagacagctcaagcaccactttctaataccactccaatcaaaaggaatgattttagcctgaggatgctggatggcttgatcttctgccataagagcccccaaacntcccctagcttccaggacaaaactctgacttattcagacgttcgccacaccttaattgcatgctgggtgccaggcacagggctgtggcctgaacaagtcctagggatgcatagactcagccatcctgtggcctccctcccaatggggtcacgactctcttcccactgccacccagagccttctcattctttaatgtgacctgttcagtcttccccaccactgcatttctctccttcttagcctcnacagggctcatcacccaaaccacagcattgagtgctgtgcttttgctttccttcactcagcaggcatttgtatgtcatttgtatgtggaaggcactggggatacattcagtatcccagtgccgtcatgaagcacngtctgagagagggagacagatgcgtagtcagtgcacnggctgcagcatgtgggggactgagagagacacctgccctgctctctttctcacctccactcagtcctataaagtggcatcatgaagcaatggaagaaagactggacccaaatcggaagacctgagctggtgctaccatctgggggacactggaggagtcattccatctcttcatctgcaaagtgggaataacaatacctaacctgcctgcctttcagagtttcaatgatgtgctttattaaataaaatgatgattttttaatgaataaaatgcatgaaagcattttacaggttataaagcactatacaagtagtactcttctgtctcctagccatgcctagcataaatctgggcacatagtagatattcagtaaatagcagttaacttaaattgatccattcaccccgcctaccaccttctatgggcgtttgaggccattggaaaccctaacactgacaatgcctgccctgcctgggggcggcagtgaggatcaagtgagaaggatgtgccttggaagctgtcagtactgaaccatcttggtcttgggaaacctccctggctccccattgtgggggcttggctgaggactggccagcccgggatgtggagtctcgggcatggggcaaccttcctccaagccctaggtccattctctgtggggagcaaacatgacacttccccaattttggttcccaaaccactcgggctgcctggctcaggatagtgcccatggcgtgggcacagtcccttgggggggccagatcagcatntgcccagccctcactagtctccacctctcgtttcagcacccctaccccacggaggatgagaagagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggacagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattagccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgtaaaaaaggtg

SEQ ID NO: 434851 - DNA, 3696 bp, Homo sapiens
acgtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagccccagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcttcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggacagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattagccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgtaaaaaaggtg

SEQ ID NO: 434852 - DNA, 416 bp, Homo sapiens
acgtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagccccagtactgaatgtggccgagacgttttcagtaaatcttattacctaccgtaaaaaaggtg

SEQ ID NO: 434853 - DNA, 525 bp, Homo sapiens
acgtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtaagaaatgctcttctgtcgtttaacatacagttacaccccccaagcaggatatcttttcttctgaaggcctctagaacgagctcagaacatgagctgacacttaacatgaacgaccttgaaagccaatcattgtgtgattattctcatgtcttcatgtcacctccttagctccttgaggaggagggctgggccttattcctgtctcttttcatctattctgtgaacaataaatggttctgtgaacaataaatccttggcctcgttgggctca

SEQ ID NO: 434854 - DNA, 1819 bp, Homo sapiens
tagcataacctgtttgtgaaactgcaaaaaggttgacatggctgaagcagaagatgggttggtactgaatggttgggagagatatgtagcggctgaccctgaaggacgttgcagcccatgctatggagacctgattttattttgtaagaggtgggcaacccctgaagcattttagtgatgcgaacagatgtgtctgttaccaagcaaagccagttaaagaaggtcacagaggaggaatgatcacaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434855 - DNA, 1715 bp, Homo sapiens
ttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgaataaaaaaaaggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttc

SEQ ID NO: 434856 - DNA, 322 bp, Homo sapiens
cccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtattttgtttatctctcccctggtcttacatacttagaatctagcttagtgccgtcgatgctcacagtgatggtttcaggctttggcgtcaggcttcttgcgttcaaatctcagttctgc

SEQ ID NO: 434857 - DNA, 1859 bp, Homo sapiens
gaaggaaatgagacaaccttttcctcccactgactcgggctcctgcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434858 - DNA, 1885 bp, Homo sapiens
tgagtagctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434859 - DNA, 1973 bp, Homo sapiens
tgagtagctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagtgcaggtaggtagatcgctgaccacatttgctcatttctggattattcattcaaaggaagcactatgagtcaatcattgggcacagagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434860 - DNA, 1762 bp, Homo sapiens
tgagtagctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434861 - DNA, 1960 bp, Homo sapiens
tgagtagctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccaggaaacatttgccagacagatgaagagaaggggggcatttaggcaacaggaagagtgtgaccaaaagcatgaagagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434862 - DNA, 1519 bp, Homo sapiens
gatgatttgaacccgatgggctgtgcctcaaaggtgaaccagggagaatcaaataaagagttccagaagtgaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434863 - DNA, 1645 bp, Homo sapiens
tgagtagctgaatacaggctcaaagcaggcgacgggacaggaatgagaggatggatgctggcaggggcttggagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434864 - DNA, 1721 bp, Homo sapiens
tagcataacctgtttgtgaaactgcaaaaaggttgacatggctgaagcagaagatgggttggtactgaatggttgggagagatatgtagcggctgaccctgaaggacgttgcagcccatgctatggagacctgattttattttgtaagagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434865 - DNA, 1522 bp, Homo sapiens
tgagtagctgaatacaggctcaaagcaggcgacgggacaggaatgagaggatggatgctggcaggggcttggagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434866 - DNA, 1820 bp, Homo sapiens
gggaattgtttactgggaattaggaagatacagggcagagaaaggagaaaggtcaggaaaatcagggatgtaaggagtttctacttccttgaaagccaggaagctcgcttgaacaaagagcacaagaccccaaatctttgtggccccactggctgggagagctcgctggtctttctttaggagccttgctagtttttgcaagcatagttttcacaagcaattgaaggataatttccttagctctatagtgaagctatacccccaaaaaagtggggctggccagagagggtctgtagtttccaaagccccaaaggacacctgcaaatcagctgttgcaatgtttcttatcactcactttatgttcccaaacagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434867 - DNA, 1849 bp, Homo sapiens
  misc_feature (55)..(55): n is a, c, g, or t
  misc_feature (63)..(64): n is a, c, g, or t
ttctccgggctgcaggaattggtacgaggagagagagagagatagagagagagantttgcatnncatataaaggagaaaggtcaggaaaatcagggatgtaaggagtttctacttccttgaaagccaggaagctcgcttgaacaaagagcacaagaccccaaatctttgtggccccactggctgggagagctcgctggtctttctttaggagccttgctagtttttgcaagcatagttttcacaagcaattgaaggataatttccttagctctatagtgaagctatacccccaaaaaagtggggctggccagagagggtctgtagtttccaaagccccaaaggacacctgcaaatcagctgttgcaatgtttcttatcactcactttatgttcccaaacagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434868 - DNA, 1474 bp, Homo sapiens
tcaccgtttgtcaataattatattttgaatacattataaaatatgtcacattggaggacaatatttgtaaccatcaaaactttggggcctggtgagaagtgtaggctggagtcatattggatctctgcatatggagttgtcatctctcaaatgcttgcttcttcctcttcttcctccagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434869 - DNA, 1465 bp, Homo sapiens
gatgatttgaacccgatgggctgtgcctcaaaggtgaaccagggagaatcaaataaagagttccagaagtgaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434870 - DNA, 1805 bp, Homo sapiens
gaaggaaatgagacaaccttttcctcccactgactcgggctcctgcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgacttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgttttttttttttttttttaattggatttcaaagaaaagaatggaaatgagaggtaaggattaaagccaaagttaggatgggaattaaaaaaataaacattacataaaatctttt

SEQ ID NO: 434871 - DNA, 652 bp, Homo sapiens
tgagtagctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaaggtcctgactttttggaatgcccttcttcctccttggctggcaatcaatctttgagactagaagttaagtctccttttgggtgaagcatcattcttcagttcctacagaccattttgttgctccctgccctgccccaggttgggggaaagcctcagcctcagcctcagcctcccctctcccctccttttttttaaaaaataaatatgtatctcttgcagtattttgtttatctctcccctggtcttacatacttagaatctagcttagtgccgtcgatgctcacagtgatggtttcaggctttggcgtcaggcttcttgcgttcaaatctcagttctgc

SEQ ID NO: 434872 - DNA, 1014 bp, Homo sapiens
tgagtagctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcaggtttaattgtttgtgagggaatccgtctgccatgtaatcaggacactgaagcagccctgtgaagaggtcaatgaggtgaggaactttggcctccagctcacagttggcaaagaaccattggtgtgtgaccttgagagcaagtcctccagctccaatcaggtcttcagatgattccaactttatgagaagttgggcgtggtggttcacacctgtaatcccagtactttaggaggctgaggcggttggatcatctgaggtcaggagttcaagaccaactttctgagagacactgggtcagaccacccagccagactgctcccacaatcctcacctaaagaaactgtcttaagctactaaattctgggggcaatttgttacacaatagaaaactaatacataaagaggctatgtattatcctactta

SEQ ID NO: 434873 - DNA, 493 bp, Homo sapiens
taagggggaattgtttactgggaattaggaagatacagggcagagaaaggagaaaggtcaggaaaatcagggatgtaaggagtttctacttccttgaaagccaggaagctcgcttgaacaaagagcacaagaccccaaatctttgtggccccactggctgggagagctcgctggtctttctttaggagccttgctagtttttgcaagcatagttttcacaagcaattgaaggataatttccttagctctatagtgaagctatacccccaaaaaagtggggctggccagagagggtctgtagtttccaaagccccaaaggacacctgcaaatcagctgttgcaaaaatatgtctttaggagtccaggctacctggaacatggcctcaggacagcagaatgtttcttatcactcactttatgttcccaaacagaagagaagaaggagagtggccacgttgattcagccaagcacctccaggaggtcccctctgga

SEQ ID NO: 434874 - DNA, 4753 bp, Homo sapiens
taagcagatggccaggtgctgcagggagaggtcttggctctgatttgtttacgaggatgaaattctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434875 - DNA, 2735 bp, Homo sapiens
cagcttggacatcaagcaagctgagctgccgcttctcctcataggacataggcttgcacttgtcctcttcctccgactcatacgtgggagggggcttgctcttcatgggcgctggctccttcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434876 - DNA, 1089 bp, Homo sapiens
ctgcctgaccagctcccattgcttggattgcagctgagaaagttgatgtgattgccggctcctccaagatgaagggcttctcgtcctcagagtcggagagctccagtgagtccagctcctctgacagcgaagactccgaaacaggttaggtgacttgtgttctacgtgtcttaccaaactcttcccacctgtgcctggcactagctcggtcctgtgtccaggatgctagagcccagagacggcactcccagaacttgctgggttcctctgtctgtctgtctctttgttaactgtctccctggggccatgaatagccctgcactctgtgcagtagtgtccattctctcggcctggccgttatgctctccctgccagggtctggtcatggaggatgaatggccaagggcgttgacactgcggagccctggatggtgggcggggaagctgggccatgaggactgtgggcgtgggggtccaggctgtgctgttgaccttgatgtgaccacacccagctttctgcaccagtggagacttcgtgtccccagggccttccccgtatcacagtcacgtgcagtgcggccgcttcagggagatgcttcgctggtttctggtggatgtggagcagactgcagctggccagccgcatcgccagtctgctgctggccctgccatcacctgggccccagccattgcctacccctccccagagtgtgctcgttgctgtgttggctgctcctgaatctgccctaactccacacgcacctggacttgcgtgtccctcctgcagttctaactaacagtcccttcttttcaagccccgtgggtctgcacgttggaccctgggttccccattagagcccaccttctgagcagcagcctcagtgggaggtggaggcaggtagtgatgctgggtgccaggtgggagtggagaggggactgctctcctccaagtgtgcactttcctcattattctcaggggcgcagatgctcaggctggcgcaggggagaggctagggagggagccatggtgcccagaaggcctggcgaccagcccctgctgagagatggagctaacatcctgtgttacgg

SEQ ID NO: 434877 - DNA, 649 bp, Homo sapiens
taagcagatggccaggtgctgcagggagaggtcttggctctgatttgtttacgaggatgaaattctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttggtgagtggagacagctgtggagcagaggacttgaagcacacactgttccaaatgacgtccagccaaccaggccaccatccactctgcctctgtccccatggggatgatgatgaagatgataaagtcgcagcctgctttttagggttgttgtgtggataactaagccaatacagatgaagtgctcgataacagcatcagctcaagaagtggcaggtacctcctgtggagctcttctaggccctggtgcaggtctgtgtgatgatggcttgcataaagctctgctaagtgtggtttaaccagccatcgtcttggcgactgcttctgccttccctggcgtctttctacctgtgtgctccatcactttaggagaggggtgagtctgaacagaccagacagaatg

SEQ ID NO: 434878 - DNA, 518 bp, Homo sapiens
gggaggaggaggaggaggaagcggccgccgcggggtccgcggcgcgcccggcccgggtaagtcccggcctggcgcgggggccgcgagcgccgctgtcccggtccgcggtcctctaggcgggctcggccgcggcgctcacgtgggccggggccggcgcgctctccttctggcacccaggtcgttttgcctgggccggggcagcgcgcccccacccccatctcttcaccttcccggcggtccccggagtgctgcggagaaaggggcaggtcccctgcggagggaggtggctgcggctgcacgccggtctgaggccaggcctcagggcgggagcggtgccctggaggcgagcttggcccgcttgacgcacccactctcagcctggcagccccttgctgggcgctttgttttgctcggtccgtgctcgccggcgtccttgcaacggcctattttatttgcagtgttgtgtggtggtggtgattgtggtgatttggggtggggatgtgggggagttgtgattc

SEQ ID NO: 434879 - DNA, 210 bp, Homo sapiens
tcagcgtcggtaccgaaggagacacaggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctcttttttttttttttttttttaaaatggagcctcac

SEQ ID NO: 434880 - DNA, 4749 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434881 - DNA, 4560 bp, Homo sapiens
gggaggaggaggaggaggaagcggccgccgcggggtccgcggcgcgcccggcccggagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434882 - DNA, 4775 bp, Homo sapiens
cagagcctttgctggctcctagtgggctctcaccacctcactctgcctcctctgttggtttgtggtctcctccctgctggagggtaagtctttggggagaggagacattggaaccctttcagtcaaagcatggggtggtccctctggccaacttggctagctaccgccagggaactcagtccttggagaccacagccagagggacttgtcattctgagcggtgcccatctgctgactgatatctcacgggggctcttctcttcctttgtagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434883 - DNA, 4631 bp, Homo sapiens
gggaggaggaggaggaggaagcggccgccgcggggtccgcggcgcgcccggcccggagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgagggcattggtgaccttaggaagacgtgacacagaagtagaaaccagattgcgacggtgtgaatgagaaggattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434884 - DNA, 4877 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagttcagaccacagatgtgattaaaatcaaccctttcaaatagaacgactctggagggagacactatacagaactcagcttttgacctctgctggtgtagtgggtaaaaatgcccagaagagatgggtagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434885 - DNA, 4224 bp, Homo sapiens
ggcagaagctctggaaaagctcttcttgcaaaaaataaatgagctacccacagaagaaacagggacagctcattttttttttgcaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434886 - DNA, 4803 bp, Homo sapiens
cagagcctttgctggctcctagtgggctctcaccacctcactctgcctcctctgttggtttgtggtctcctccctgctggagggtaagtctttggggagaggagacattggaaccctttcagtcaaagcatggggtggtccctctggccaacttggctagctaccgccagggaactcagtccttggagaccacagccagagggacttgtcattctgagcggtgcccatctgctgactgatatctcacgggggctcttctcttcctttgtagagtgcctggtgaagaatgtgatgggatcactagcatgtctgcggagagcggccctgggacgagattgagaaatctgccaagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagttcagaccacagatgtgattaaaatcaaccctttcaaatagaacgactctggagggagacactatacagaactcagcttttgacctctgctggtgtagtgggtaaaaatgcccagaagagatgggtagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434887 - DNA, 4828 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagcgatagctcctcggacagtgacagttcgactgatgactctgaggaggagcgacccagcggctggctgagctccaggagcctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434888 - DNA, 4329 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434889 - DNA, 4223 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434890 - DNA, 3715 bp, Homo sapiens
gtgccgacattttcaccatagtgttttgaggcttttttagttttaagacttgttacgtgtttcttcttctgggagtggagtcccaagcatggggcaggcagagcagggaacagtgctgtgtccctttgaccagctcctgtactgtgtcatcacgatgagctgggcccagccctctccatcagttctccccgtcatttctggctcaggctccgcctcctgtgggttctgagtccacctgcctgcgagccaggcaggtgagctgggatgttggcagggccagtcccagccctgaggctgagaactggggtgatggcctgtccccccactagagtcttgaccaaactgagagccaagaaaccgacttgctcttctaggcatccctttcgtctgctgccagccacttctccatggtcacattgggcagacacagctaacagggacttgtcttgtgttccagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434891 - DNA, 3541 bp, Homo sapiens
agcgggatgtgcctgagggaagggacaaggtgggcaggctgtccctccacatcagaaccttcctagaccttttagtccaagaggaagcccaggccctggaacggtggctgcgtggatttttcccgccaactcgaagaaactcagcgccccctgctgtctgctgtgggacgtgctctgagacctggtgcttggccattgtggctacagatgcctgtgctgccccttcccctagtctgaggaaaagcaagacaagccctctggccttgggggcccagtgccccagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434892 - DNA, 4167 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggaccagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434893 - DNA, 3630 bp, Homo sapiens
cccctagaggaggtgcgcttgtggcaggtacattcccaccggggacctctgcgtgtgctgtgtcctctgcctggaatgccctctcaaaccacagacaactcctgctcccccgcacgcatctggtgggagcctcggctaactgttttggggtttgaggatgcccttggtccagtaccatctcagacttcagtgagctggctgtcttagtggcctgggtctcatgtccttgcctgggcggtgtcctccagggagtgagtgccccgctatctctggaccaccttgttcttcaaagtgagatttgagagaagagtgttgcaagagttgtcagaggcccttggctggcccttgcccctgtctcggcagcaaagagacaggatcaccatcctctttcgccctcggttgctttctgttgagttggccccagcagccaatgagggcaggtgatgctaggccgcggcctgggtacccagcagccgtcacagcatgtctttccctcaccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434894 - DNA, 3228 bp, Homo sapiens
  misc_feature (11)..(11): n is a, c, g, or t
  misc_feature (38)..(38): n is a, c, g, or t
  misc_feature (94)..(94): n is a, c, g, or t
aaggagaaagncaagaaggaaaagaaaaaagaaaagcncaaaaggaaagaggaagtggaagagaataaaaaaagcaaagccaaggaacctctcnctaaaaagacgaagaaaaataatagcagcaacagcaatgtgagcaagaaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434895 - DNA, 3257 bp, Homo sapiens
gacgtgtccgtgtgctcttacttagattcttaggggccctccttctgcgatcaggatggccgtgagacttggtgtctgtcggcttgatcagctcctctggtgaggaagacactggcagtctttggagttgagtgaatgggtggagatagtcttgttaggaatctggttaacatgacaggcgcaaagctgggggccttcccttcccctgcctcccctatgcccacaccctgatgccccaggtgcatgctgtcgcatgttttttggagcagacgcctgggtcttgggtgacaggaaggtggtttcagccctgagtgtgtgtcttgcctgtctggtctacactcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatcccctcaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgt

SEQ ID NO: 434896 - DNA, 3382 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggttaggtgacttgtgttctacgtgtcttaccaaactcttcccacctgtgcctggcactagctcggtcctgtgtccaggatgctagagcccagagacggcactcccagaacttgctgggttcctctgtctgtctgtctctttgttaactgtctccctggggccatgaatagccctgcactctgtgcagtagtgtccattctctcggcctggccgttatgctctccctgccagggtctggtcatggaggatgaatggccaagggcgttgacactgcggagccctggatggtgggcggggaagctgggccatgaggactgtgggcgtgggggtccaggctgtgctgttgaccttgatgtgaccacacccagctttctgcaccagtggagacttcgtgtccccagggccttccccgtatcacagtcacgtgcagtgcggccgcttcagggagatgcttcgctggtttctggtggatgtggagcagactgcagctggccagccgcatcgccagtctgctgctggccctgccatcacctgggccccagccattgcctacccctccccagagtgtgctcgttgctgtgttggctgctcctgaatctgccctaactccacacgcacctggacttgcgtgtccctcctgcagttctaactaacagtcccttcttttcaagccccgtgggtctgcacgttggaccctgggttccccattagagcccaccttctgagcagcagcctcagtgggaggtggaggcaggtagtgatgctgggtgccaggtgggagtggagaggggactgctctcctccaagtgtgcactttcctcattattctcaggggcgcagatgctcaggctggcgcaggggagaggctagggagggagccatggtgcccagaaggcctggcgaccagcccctgctgagagatggagctaacatcctgtgttacgg

SEQ ID NO: 434897 - DNA, 2608 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacagagatggctccgaagtcaaaaaagaaggggcaccccgggagggagcagaagaagcaccatcatcaccaccatcagcagatgcagcaggccccggctcctgtgccccagcagccgcccccgcctccccagcagcccccaccgcctccacctccgcagcagcaacagcagccgc

SEQ ID NO: 434898 - DNA, 2918 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgctggcagcgacagctctcgtgtcagatgctggtgctgccacatcctggacagagccactggagggacccccgtaggggtagaacaatcccaaaaagcaatagaggggagaacagtgtcaaacagaaccagattatccaaggcaaccactatcggaatggcacacaataccgaacgtggaaacacgaaacgtgtggaaaccaccaagcaaaggggaaaaagcacaaacaaacaaaaataccaggaacagatatgcacatgtaaataacaaag

SEQ ID NO: 434899 - DNA, 2739 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaaggtgtgcttgggccccctgggcatggggttccttctgtgggcaccctcagagtaacttttccctccttgctcagtccactctttctgcgcccccccccttttttttttccaattataatatctgtgttcttgacacagaaacctccgaaaggttgtgacattgcactcacccctaggctgtcagtgcctttctacatatctgactggtggtgtctggggcctctctgcaccttgttgcctgcagctgtgttctaagccggagctgctttcaacccaggctacctgctgctgagtcttcctccggcctctttggggaaggaggaaaggcgggtctgcagggtcccaggacctgtgtaccgatacgttatgcagcactgagccagcctctgtccctctctagcagggacagttcgg

SEQ ID NO: 434900 - DNA, 2608 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataggagcaacggaacacaggcaggaggaggatggcgggggtgggtgctgctttcccagctgtgtcccaggccaccatgtattccccaccctctgccccagcagcatgcagtgcagtgggccagccctaccacttcctctgattccagctattgcttgggctgtggtcttccattgagctgtgattccagctaaagcctggagctgcttgaggattctgtattgagacaggcaggggtagggcacaaatgccactctcccaccacccctagggcatctgcagacctgggtggagcaggctggaggaagacactgtcccaggtgggctgtggacagtactgtggctttgctgtcattagcactggggttaggtctgccaagcacatggggcagggcatgtcctaggaatcttctagctttcacttgtcacatagctgacatctggttcttcccaagtgtcatgcacaggtctttgtgagcagaagtgtccccacagcttatgtccctcttaggaatacccgtttaacctcatccagcgacagcagcagcgatagctcctcggacagtgacagttcgactgatgactctgaggaggagcggcccc

SEQ ID NO: 434901 - DNA, 1985 bp, Homo sapiens
gctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagctagcggccgcaaacttacacccccagaaagcgagggacatccacaggaaggagag

SEQ ID NO: 434902 - DNA, 2393 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccacccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctcttttttttttttttttttttttttttttccccaggttttcgggttgt

SEQ ID NO: 434903 - DNA, 2432 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccacccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctctttttttttttttttttttttttttttttttttttttttttttttttttttttttttttttttttttccccaggttttcgggttgt

SEQ ID NO: 434904 - DNA, 2245 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaaacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccacccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctcttttttt

SEQ ID NO: 434905 - DNA, 818 bp, Homo sapiens
actgagaaaggaagggccaagggatgaggtgggaaccgggccctgggggcgccacagactaaggcagagactcccctacctggcgcccagccccaaccagcagcagcagcagcgccaggagcaacagcagcagcagcaacagcaagcagctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccacccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctcttttttt

SEQ ID NO: 434906 - DNA, 2019 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctctttttttttttttttttttttttttttttttttttttttttttttttttttttttttttttttttttccccaggttttcgggttgt

SEQ ID NO: 434907 - DNA, 2353 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccacccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctcttttttt

SEQ ID NO: 434908 - DNA, 2072 bp, Homo sapiens
  misc_feature (1988)..(1988): n is a, c, g, or t
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccaccccccccccctgaaagattagagatctttaatttatcagcagtatattttagnttcgctgcactgcgtaaagccactcttggagaaaaataatgtggaaaaagtggtggttgttattttggataaagagcaccgccc

SEQ ID NO: 434909 - DNA, 1940 bp, Homo sapiens
gccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctcttttttt

SEQ ID NO: 434910 - DNA, 519 bp, Homo sapiens
cagagcctttgctggctcctagtgggctctcaccacctcactctgcctcctctgttggtttgtggtctcctccctgctggagggtaagtctttggggagaggagacattggaaccctttcagtcaaagcatggggtggtccctctggccaacttggctagctaccgccagggaactcagtccttggagaccacagccagagggacttgtcattctgagcggtgcccatctgctgactgatatctcacgggggctcttctcttcctttgtagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaggcgggagccacaccaatggagaagtggtcatcatcatctccacctcattgccatcccgg

SEQ ID NO: 434911 - DNA, 1113 bp, Homo sapiens
catgtatttgatcacattatataaaactgtaatgtcagtgctgctagggaaagtgagctgccatattgtaggttgcccacatagaggatcacatgacaggaactggggatgccttccagacaccagccagtgagaaactgagacccttggtctgaaagtctacaagaaactgaattctgtcaacaaccatgtgagcttagaagagaatgcttccccactgcagcctcaggagagacaccagacctggctgacacctggagtccacccttgcagaggacctagcagagtcaggtccaggctcctgacgcacagaaactgtacaacaataattgtgttttttaagccaataagtttgtattaataatgttatacagcaatagaaaatacaaaatccttatgaaaattccactatttttacaaatccaagagagaaaagtagtatcatatctttttctattaccttctcaataaccttaacaaacaaaagccagaattttaacggggtattttattttcagagatgagatcttgctatgttgcctaggctggactcgaactcctgggctcaagtgatcgtcccaggcattaacaatgtattttagaacaacaataagagcttatatgagatggactgactgtcgtaaatttttcatcagagcctcatattatagctgccagaggcatttcattattcttaccggtttttgaaggggagtatatttccacctctgtcaagtatgcaccctctattattcaaaaaaatatggaataatgtgattatgatagtgtcttacactatcaattgctaggcatgtaattcacactcaaaaattcttaccagtttattagtgacttctactataataaagtatataagcaacagatgcctcaatatgaatggatcaaaacgttaagtgcaaatgtatcttaatcaagatgtgtttataagagcttttgtgctaatattcggcaatactctcaattatttcaatgcaatttcattactcaattatatctcactcacttataccttattttgtagaaagagaaaccaaccacaaactattggcccaggcttgcaaatttaaaataaaaactgctttgctagtagca

SEQ ID NO: 434912 - DNA, 788 bp, Homo sapiens
caatttctacacctttctctccagtcctccaaccagccatacacagctacccctgtttacttcaggatacaatgaaagtggcctaggaatttttcaaatatgctacccatgggaggagccgttttcattcctacctgtcaactagaaaaaatacaatagcaacataggattatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagacttttaaatccttttca

SEQ ID NO: 434913 - DNA, 1905 bp, Homo sapiens
ataggcagcaaactaagctgcagtgatgttgcctatatttaaattttctcaaatggccaagctctgatggtctactttatttgagcaatagttgagacttataattgcctataaataaacaaacaaatgaactatttgtttttttttctcacaacatctggcctatattgtctgtcaggaagccatggctccaatgtaaagtacatagttcttacatacttcaactgcagctggtccctgacctcaccaggtttcagagatgttcttaaaggaagccagctgtggcaggtcacagattcatgggaaatggaaagaaccaaggaatatagctcttgcctcacctttctacccactgcagatatagttcaagccagagtaatggaagaacttaacttactagcctctcaggctgctcctatccctacctcccagtgtacagcccctccccatctctttagtcccctttccctcacttccccttttataatgtcacacaaatcagggacagtaggatcacattataacctactttgtcatagggattcgatttttcttatatcaaatcatgtttcctgaaacccagctggggcatatgcactcaatgtctaatacatacttattaatgtaccggatattggccttgcccctggatatcagcaatatattataaaaggttccagtagatgagacgattgagtctgaatacaattgcagtaaattgtgccaataaagatattgtactgttacggtcttagagttaaagccgcttgaatgcagcatgcacattcatgtaaacagacaatcagggtaggcctagaataaccacaaaaattctattggccttactgcagccacctatatgtagaacaatggaggagatagtttgtggtccattattgtaccctgtttcatccattagcatcagaatctctctttcaggtcatttattaaatatgattgaaatgtttaaaagttcctgaacatgattcatgatgattaaaatatcatacaactgataaaagactttaagaactttatatatttcctgttgcctcaaaatgtaacagaaattattcttagagctttgattttagctatcctaattactgcaaataaatatttgttcttatagttttaaatcaaaaagaaaagtcttgttataaaaccttaagcttgaaatcatattaataaaatatattgtacatagtggaaaattttcagtagctaatttaaaatttcagaaaatgctattaaagaattttgattcaagtatttaaactgtttagttatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagacttttaaatccttttca

SEQ ID NO: 434914 - DNA, 1851 bp, Homo sapiens
ataggcagcaaactaagctgcagtgatgttgcctatatttaaattttctcaaatggccaagctctgatggtctactttatttgagcaatagttgagacttataattgcctataaataaacaaacaaatgaactatttgtttttttttctcacaacatctggcctatattgtctgtcaggaagccatggctccaatgtaaagtacatagttcttacatacttcaactgcagctggtccctgacctcaccaggtttcagagatgttcttaaaggaagccagctgtggcaggtcacagattcatgggaaatggaaagaaccaaggaatatagctcttgcctcacctttctacccactgcagatatagttcaagccagagtaatggaagaacttaacttactagcctctcaggctgctcctatccctacctcccagtgtacagcccctccccatctctttagtcccctttccctcacttccccttttataatgtcacacaaatcagggacagtaggatcacattataacctactttgtcatagggattcgatttttcttatatcaaatcatgtttcctgaaacccagctggggcatatgcactcaatgtctaatacatacttattaatgtaccggatattggccttgcccctggatatcagcaatatattataaaaggttccagtagatgagacgattgagtctgaatacaattgcagtaaattgtgccaataaagatattgtactgttacggtcttagagttaaagccgcttgaatgcagcatgcacattcatgtaaacagacaatcagggtaggcctagaataaccacaatttgtggtccattattgtaccctgtttcatccattagcatcagaatctctctttcaggtcatttattaaatatgattgaaatgtttaaaagttcctgaacatgattcatgatgattaaaatatcatacaactgataaaagactttaagaactttatatatttcctgttgcctcaaaatgtaacagaaattattcttagagctttgattttagctatcctaattactgcaaataaatatttgttcttatagttttaaatcaaaaagaaaagtcttgttataaaaccttaagcttgaaatcatattaataaaatatattgtacatagtggaaaattttcagtagctaatttaaaatttcagaaaatgctattaaagaattttgattcaagtatttaaactgtttagttatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagacttttaaatccttttca

SEQ ID NO: 434915 - DNA, 1351 bp, Homo sapiens
ataggcagcaaactaagctgcagtgatgttgcctatatttaaattttctcaaatggccaagctctgatggtctactttatttgagcaatagttgagacttataattgcctataaataaacaaacaaatgaactatttgtttttttttctcacaacatctggcctatattgtctgtcaggaagccatggctccaatgtaaagtacatagttcttacatacttcaactgcagctggtccctgacctcaccaggtttcagagatgttcttaaaggaagccagctgtggcaggtcacagattcatgggaaatggaaagaaccaaggaatatagctcttgcctcacctttctacccactgcagatatagttcaagccagagtaatggaagaacttaacttactagcctctcaggctgctcctatccctacctcccagtgtacagcccctccccatctctttagtcccctttccctcacttccccttttataatgtcacacaaatcagggacagtaggatcacattataacctactttgtcatagggattcgatttttcttatatcaaatcatgtttcctgaaacccagctggggcatatgcactcaatgtctaatacatacttattaatgtaccggatattggccttgcccctggatatcagcaatatattataaaaggttccagtagatgagacgattgagtctgaatacaattgcagtaaattgtgccaataaagatattgtactgttacggtcttagagttaaagccgcttgaatgcagcatgcacattcatgtaaacagacaatcagggtaggcctagaataaccacaaaaattctattggccttactgcagccacctatatgtagaacaatggaggagatagtttgtggtccattattgtaccctgtttcatccattagcatcagaatctctctttcaggtcatttattaaatatgattgaaatgtttaaaagttcctgaacatgattcatgatgattaaaatatcatacaactgataaaagactttaagaactttatatatttcctgttgcctcaaaatgtaacagaaattattcttagagctttgattttagctatcctaattactgcaaataaatatttgttcttatagttttaaatcaaaaagaaaagtcttgttataaaaccttaagcttgaaatcatattaataaaatatattgtacatagtggaaaattttcagtagctaatttaaaatttcagaaaatgctgttttaaaatattgtgatccaggtttttacagctgaatatttccggttgcttttttttccccccaaaatgattccccctcatttatttaggcccatcttatt

SEQ ID NO: 434916 - DNA, 3725 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434917 - DNA, 862 bp, Homo sapiens
  misc_feature (824)..(824): n is a, c, g, or t
  misc_feature (831)..(831): n is a, c, g, or t
  misc_feature (845)..(845): n is a, c, g, or t
  misc_feature (849)..(849): n is a, c, g, or t
  misc_feature (855)..(855): n is a, c, g, or t
tggctagtagggccggtgtgaatcggccgagggcacttttccctggctctttcactaaaaatgaaaaattgtgatcttgcttcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcagcggaaatctgactggtctgaattgctcagcntcgggcntgtgtcactagggntggncctganggggagc

SEQ ID NO: 434918 - DNA, 837 bp, Homo sapiens
ccttaggcataggtacgaggcctgggtgtacatgactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggaccgaatagaagtctgcggtctggactctgtgccccaccggtccttcttttctctgagc

SEQ ID NO: 434919 - DNA, 668 bp, Homo sapiens
  misc_feature (16)..(16): n is a, c, g, or t
  misc_feature (19)..(19): n is a, c, g, or t
  misc_feature (24)..(24): n is a, c, g, or t
taggctaggtgcgagnccnggtgntgagactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtagtatagcttatggaagtg

SEQ ID NO: 434920 - DNA, 4113 bp, Homo sapiens
aggcgaggcgggcgccgggaggggcaggcccagcccacggtgcagcgcgcgcggagccctcgccttcctccgacgcactgtggggctgcaggggaagctgcgggccgtgggggccggaggagaagccggctccacgcgcagctgctggcgaatgaggaaagatccagctctgacagaataatgagttgtgcaaagtgaaggccaaatgacatcaccggagatagcagtagttcaaagaaagcaaagcagaggaattgaactgctgcaaaatgcacgagtctcaaacattgtctcagcagcagcatcatatcttacaaaagttgaggaaatactgtatttccagcttaggaaactgaagattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434921 - DNA, 3943 bp, Homo sapiens
atggtgttgatgaacctgtgtgtgcagtcatagatacatcgtgtgtgtttgcaaaaatggcgaatgaggaaagatccagctctgacagaataatgagttgtgcaaagtgaaggccaaatgacatcaccggagatagcagtagttcaaagaaagcaaagcagaggaattgaactgctgcaaaatgcacgattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434922 - DNA, 3901 bp, Homo sapiens
aggcgaggcgggcgccgggaggggcaggcccagcccacggtgcagcgcgcgcggagccctcgccttcctccgacgcactgtggggctgcaggggaagctgcgggccgtgggggccggaggagaagccggctccacgcgcagctgctattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434923 - DNA, 3683 bp, Homo sapiens
gactagaacccaatcttacggctaggtacgaggcctgggtggtgaatcccttagaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434924 - DNA, 3718 bp, Homo sapiens
aagacggacgacttacgctaggtacgaggcctgggtgtgctggtgacacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434925 - DNA, 3788 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctataaaaaaaaaaaaaaaaaaaaaaaaaaaaaagggggggggcaaaaagaaccccggggggggccca

SEQ ID NO: 434926 - DNA, 3841 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctataaaaaaaaaaaaaaaaaaaaaaaaaaaaaaggaaaaaaaaaaaaaaaaaaaaaaaaaaaaaaaaaaaaaaaaaaaaaaaaagggggggggggcaaaaagaaccccggggggggccca

SEQ ID NO: 434927 - DNA, 3810 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctataaaaaaaaaaaaaaaaaaaaaaaaaaaaaaaaaaaaaaaaaaaaaaaaaagggggggggggcaaaaagaaccccggggggggccca

SEQ ID NO: 434928 - DNA, 3598 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccattctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434929 - DNA, 3633 bp, Homo sapiens
atctgcctggggccagtgaggagaatgcatctagacagagcttttcgtgctgctgagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434930 - DNA, 3551 bp, Homo sapiens
gagaatcgcgtgtccgattgaggatgatcgatgactctcaaacccacgcgtctgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434931 - DNA, 3727 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttctactagactatggtgagctcaggtgagttgatactcctgatgcgagtaatacggatgtgttataggagtgggacttctgaggggataaagcggggtgatgcctgttggcttaatgtacggggatactctagagcc

SEQ ID NO: 434932 - DNA, 3109 bp, Homo sapiens
agagatgttttgtgtgtcagcttcatcacagagcaagatggaaaaatataggcctcatcagtctcatgccaaccagaatgggccttcaacttatggtgctggtttgattgaatggaccactgcatgagtggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434933 - DNA, 3674 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacatgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434934 - DNA, 2703 bp, Homo sapiens
ccttaggcataggtacgaggcctgggtgtacatgactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434935 - DNA, 3136 bp, Homo sapiens
agagatgttttgtgtgtcagcttcatcacagagcaagatggaaaaatataggcctcatcagtctcatgccaaccagaatgggccttcaacttatggtgctggtttgattgaatggaccactgcatgagtggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaagctgactgacttctacagcaatataaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434936 - DNA, 2697 bp, Homo sapiens
  misc_feature (16)..(16): n is a, c, g, or t
  misc_feature (19)..(19): n is a, c, g, or t
  misc_feature (24)..(24): n is a, c, g, or t
taggctaggtgcgagnccnggtgntgagactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434937 - DNA, 2858 bp, Homo sapiens
accaaaacaaacaactgtgtatagactgctgttttctttggatttgaaatgaggcatttgggtgttctttcccctaccatacggcctgtctgcccttccctccccacattggctccagcagagtagccgaaggtcctgccgccgccgccaccaccaccaccactgcagcaacttcagtactgacatcagactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434938 - DNA, 1781 bp, Homo sapiens
cacgaggcccactccaccttactaccatgcaaccttacccaaatcatttaccccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434939 - DNA, 1814 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatcactgaatatctcgaaagaaattgtggtggccgacagcaatgatgacctttttgtcactggtgacatgaacttgaggagcgaaaaagtctcctctctgttcagacccaatataagcgcggcggcctgacccacgc

SEQ ID NO: 434940 - DNA, 987 bp, Homo sapiens
gaatactccatcagctgttagctctacaatccgagcttgtaccagatcttgagatcttgattactctgacctcaacatggctcctgactaatggtgagaggttgtcaccaataaagggtgtcccggagcatcacgagcagtcgtgagcagatctgaaatcggatgactagagcggatcctctacgggattctagtcatactacgcaagtcctaaaggacctcagcatatacgatacttagtgcctcgtgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctata

SEQ ID NO: 434941 - DNA, 801 bp, Homo sapiens
  misc_feature (763)..(763): n is a, c, g, or t
  misc_feature (770)..(770): n is a, c, g, or t
  misc_feature (784)..(784): n is a, c, g, or t
  misc_feature (788)..(788): n is a, c, g, or t
  misc_feature (794)..(794): n is a, c, g, or t
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaatgatcaccctgtcagtgccagacacattgctgacagaacatcacaaaagaggtaccttcacattcggaaatctgactggtctgaattgctcagcntcgggcntgtgtcactagggntggncctganggggagc

SEQ ID NO: 434942 - DNA, 697 bp, Homo sapiens
gactagaacccaatcttacggctaggtacgaggcctgggtggtgaatcccttagaggggttcctggtcatacaccagtactaccaaggacagcttttttcctgcaagagggcagcagtgatgcacaggaaaagggaaattactcaagcactgtttctcagcaagactgtcgcttttctgagaagaaaacacctagaaagcgcctcagattcccatagctgaattatgagaggatctgttacctaaagcaataaaaaatggccagaggatcagtgtccgatgaggaaatgatggagctcagagaagcttttgccaaagttggtgagtagacctggtaccccaaattgcatcattctcttcttcactgagtagcttcagggtagattcaatgaaatgggaacatgagcaaaatttcagagatgacaagaaaccagtagtatttgtttagaggagctgggagaacttatttttgaaaaatatgcttcaataaaatgactttctctatctaagtctcatcttttatatcttgtcttctgttttgctgtttccttgattttaataccatcacatactttctcttactctttatcactaaacctgtggtttccttaagagtttctataagagttctttgtggaaacagaggtaccttatagaaattatgactcttttactgtggatgttgaaagtaatgctgg

SEQ ID NO: 434943 - DNA, 626 bp, Homo sapiens
gactagaacccaatcttacggctaggtacgaggcctgggtggtgaatcccttagaggggttcctggtcatacaccagtactaccaaggacagcttttttcctgcaagatctgttacctaaagcaataaaaaatggccagaggatcagtgtccgatgaggaaatgatggagctcagagaagcttttgccaaagttggtgagtagacctggtaccccaaattgcatcattctcttcttcactgagtagcttcagggtagattcaatgaaatgggaacatgagcaaaatttcagagatgacaagaaaccagtagtatttgtttagaggagctgggagaacttatttttgaaaaatatgcttcaataaaatgactttctctatcaaaacatggaatatggactctactcttacatagtttgttcctggaaatggtttgtaagtctcatcttttatatcttgtcttctgttttgctgtttccttgattttaataccatcacatactttctcttactctttatcactaaacctgtggtttccttaagagtttctataagagttctttgtggaaacagaggtaccttatagaaattatgactcttttactgtggatgttgaaagtaatgctgg

SEQ ID NO: 434944 - DNA, 749 bp, Homo sapiens
gactagaacccaatcttacggctaggtacgaggcctgggtggtgaatcccttagaggggttcctggtcatacaccagtactaccaaggacagcttttttcctgcaaggtaaatgttcttcatgtgtttttgttggttttaagcgcttgtgatgcacttcggcactgtttctgtggattgtgggttttgccttcaggggaccagagatctgagcatgtcacctgagacctctgtgattcctgccactgtctaactggccaggacatctgccgccacctcgcgtggccatccaagatggagcacctcggctctctgggctgggttcttctcaacttatctgcagttatcacccctgcccaaaattaaggtttctttttccttttaaaaccaaaccatgttctggtttatttctattgctctatttcacggaggctatttactgtgattttatcttctttaaaatgttttcaggaaaagcgcgtattgataatttagattgtatggcttattggcccaatgggggtagtttaattttagttcctgcggttctgtttttctaaaaaacttctttacagtactttagtggataaattatctagagtcatatgttactgaatgtgatactggttatttgagtgatttttggcgccaagggtttttaatgggtgtgctttataaccacatggaattagaggttttctcttttccatttgttctctaaaaataaaagcaatttgtataatgcttaat

SEQ ID NO: 434945 - DNA, 317 bp, Homo sapiens
atgcatacatatacattagtgcagaagtctgaactgtattgttgaatgtggcttcttgtgtagtaatgtagtaatatgtagtaataatactgtgtagtaatcttgggcagtgatgccttgtgaggctgttgagataaggaggaattggctttgtctaaatatctgctattgctgagctagaatgggaagtgacaaacttttcatgtgttatgtcaccatttacctgaaactttggttgaatgcagtgacccatttttctttctcttcttttattttttctttatctttctgtctttctgtctttctttctggcagtg

SEQ ID NO: 434946 - DNA, 1294 bp, Homo sapiens
gcaagtgggagaaaactaatcaatggcacacagggcagggtgtggccctatgggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaatatctttcacgtatat

SEQ ID NO: 434947 - DNA, 301 bp, Homo sapiens
cttgaatataactgcctaatctaatataaccacctagccatctttagtcacatcattctatttcaatttcctcttaagctctttttactatcagattgtttttgttttttggtcatctgcctttcctttgtagaatgcaggctccatgagagtcgggagcttggctttctgattcaccaccatatcccctgtgggcagctttgatgtgcgcaagacagctgacgactgagccctgcttctgctggggctgtgtacagagtgcaaatgtttatttaaaataaagttctatttatcccttgtg

SEQ ID NO: 434948 - DNA, 352 bp, Homo sapiens
cctgcctcagcctcccaagtacttgggactacaggcgtgcgccaccatgcctggctaatttttttttgtatttttagtggagacggggtttcaccatgttggccaggctggtcttgaactcctgacctcaagtgatccacctgccttggcttcccaaaatgctgggataacaggcatgagccattgcctccagctgaaacatgctttctcaaaggaattgggatcatatgcaggtagaagggcagctggtatgtgtttgcctgaaggatagaatgacaagacgtgaagagcgagagatcacagaaagaatagaacgagttaagaaggctcgagaagagcatgagagagccca

SEQ ID NO: 434949 - DNA, 870 bp, Homo sapiens
cctgcctcagcctcccaagtacttgggactacaggcgtgcgccaccatgcctggctaatttttttttgtatttttagtggagacggggtttcaccatgttggccaggctggtcttgaactcctgacctcaagtgatccacctgccttggcttcccaaaatgctgggataacaggcatgagccattgcctccagctgaaacatgctttctcaaaggaattgggatcatatgcaggtagaagggcagctggtatgtgtttgcctgaaggatagaatgacaagacgtgaagaaagataggaatgactaagagctagtcattcttgccagcctctgacagtgtgagatctgcagcagtgtttactagttcattttctgtgaagtcagtccttgataatttgtggtacaaagaaaggaaataacaagtctgacagtaatcttcctacctttgtagagactccatcatcccttctgaatccctgttggccctaccctgctgaggaagtttatcagggtgggctcccttcctgcacttcctgcgcttggagacattggagagcccacattgaaaatctcttcagttaaccacatttaagtcccttcagtccaaagaggaaatggccactggagtctgctttagttcccacaagctttgggttgctccttcctcctgttcacatgttaatgtctttagaggttcagaggggcatggaagctactgagagactgacttcctggggaaaggaagataacttgtaaccttaagttggtgttttctttttttttttgagacaaagtctcgctctgcagcctgggctatagagccagactccatctcaaaaattaaaataaaataaaataaaataaaataaaa

SEQ ID NO: 434950 - DNA, 1467 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttt

SEQ ID NO: 434951 - DNA, 973 bp, Homo sapiens
tttcctgcgtttccctgatcctgtggatattcgttttcctcgcctgacgcttgttgaatcgccggtccttgaggatctgtttatccgactcactttgggctgctagttccctgtcactcgtacggcctgatgcgcagcgaagtcaggtgtggcgaggtatcgcgccgtgcattaactttcggtattagcaatacattattacgtaacgtttctcaggttcgtgcggttccccggcacatatcgcccggggaaattcggcccattacgggcccggtgggtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttt

SEQ ID NO: 434952 - DNA, 1215 bp, Homo sapiens
cgaactgatagctccactgattacatgtaaccaacctaatgccagtttaacatgtacaaattcttggaaaagaaactcttttgatccaaattggtataggtatctcaacattagcaagagagaactgtgccatagtacaccttgcagcactttagacaagtagaatttttgtttaaaggtgtccatgggcaaggaagaaatcacatgactacataatggttaatccctttgttgcaggtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggttacaggtattctgctgagttttttctttctttctttctctctctctctttctttctttctctttctttctttctttctttctttctttttttaactgtaaaccagaaaacaattgtggggatcaaggacagacatagcacttagacaggactttcatgacccaatatggaacaatttgagtaccagaataggagattatggcctattgaacaaaatgtgaaactgggagtccacaaagacataaatggaaagatgaagtacctcctgacagagcaagaatggcactgaacaatgttatatggacaatggctattttattcaagactattacaatagggaaaagagactaggactcagtctgaactgaaatctgtcaaaacaaaggggggtggggctttaagagtgaaggtgaggaggagatcacacaccgtatgtgtttgctaactggctttacccaaaagaaaattaaactttctttgatctgtacaagttgatcaaacaaatggggtcattcttgtcatatgcaactaaaacagggtagacaggccaggggaaaaaggcactcagggcacacagcattgcttcaaaatataattctctacaaacctagttgctaaaactacctgttgtaacctaaaaccagttttatctaacagctattaaaacaacctactgtgactgcaaaactggttttacccacca

SEQ ID NO: 434953 - DNA, 670 bp, Homo sapiens
ggaagtggacaaatagtgtaataaatatgtggtaattggaaatgctgtgcgagagctcaatttcaaacttgtctttctaggagcttacagtttgaaaattgtgaaggaatagatattcaaattgaacatttatcaatttggaatcatatctaaagaaaatgtatctaacatatttgtttcacaaaaaaaactgaaggtcagaggaaaaataaagtactttttcaaaactccatagctattttctagtgaggccaggagttgaacaattgttgccttgcacttcacaacctacgaaacaagaggtacacagtaggttgtcataaaaattggcatgtatgattttgaaattaattttgtctctaaagaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttt

SEQ ID NO: 434954 - DNA, 1013 bp, Homo sapiens
  misc_feature (956)..(956): n is a, c, g, or t
  misc_feature (1001)..(1001): n is a, c, g, or t
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacgtatgatgaccaacatagtgtttataatggtggngtttaataacactaatattattacccgataggtctctcgagatcncagggttgcccc

SEQ ID NO: 434955 - DNA, 927 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaatttctgtcatttggtggtattgagagtgagagatttcttccaaggttatatgaagtttcccaggttgtataagacaccaaagtgttataatggtctccattcatcagtttccactgatta

SEQ ID NO: 434956 - DNA, 1531 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattgg

SEQ ID NO: 434957 - DNA, 1037 bp, Homo sapiens
tttcctgcgtttccctgatcctgtggatattcgttttcctcgcctgacgcttgttgaatcgccggtccttgaggatctgtttatccgactcactttgggctgctagttccctgtcactcgtacggcctgatgcgcagcgaagtcaggtgtggcgaggtatcgcgccgtgcattaactttcggtattagcaatacattattacgtaacgtttctcaggttcgtgcggttccccggcacatatcgcccggggaaattcggcccattacgggcccggtgggtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattgg

SEQ ID NO: 434958 - DNA, 1323 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaatgagaggctgtgcacgatgttcctacctaactgatgatggttcccgagcaagtagctgttccccctcagataatgttttgcacgaaagaatcactaactttag

SEQ ID NO: 434959 - DNA, 1455 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatggtaagtaatttaatatacattctttgtgaattttcttgagtcggagcattagaaatattcaaacaccattataatcttgaagtcttttcactcatgcctatctatgcagaaaattgaagatgttcagagtatgccatgtgacataaaggtgaaacacctagtgatgctctgtttgaagaatgtaagactaacatcaagtagtagacttaatacctatctttatattttaaagagtgtacacagaagagcttgataatgtttgaaaacgttttaagagccaatactccaccaag

SEQ ID NO: 434960 - DNA, 1392 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacgttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttt

SEQ ID NO: 434961 - DNA, 2244 bp, Homo sapiens
tcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggttacaggtattctgctgagttttttctttctttctttctctctctctctttctttctttctctttctttctttctttctttctttctttttttaactgtaaaccagaaaacaattgtggggatcaaggacagacatagcacttagacaggactttcatgacccaatatggaacaatttgagtaccagaataggagattatggcctattgaacaaaatgtgaaactgggagtccacaaagacataaatggaaagatgaagtacctcctgacagagcaagaatggcactgaacaatgttatatggacaatggctattttattcaagactattacaatagggaaaagagactaggactcagtctgaactgaaatctgtcaaaacaaaggggggtggggctttaagagtgaaggtgaggaggagatcacacaccgtatgtgtttgctaactggctttacccaaaagaaaattaaactttctttgatctgtacaagttgatcaaacaaatggggtcattcttgtcatatgcaactaaaacagggtagacaggccaggggaaaaaggcactcagggcacacagcattgcttcaaaatataattctctacaaacctagttgctaaaactacctgttgtaacctaaaaccagttttatctaacagctattaaaacaacctactgtgactgcaaaactggttttacccacca

SEQ ID NO: 434962 - DNA, 1105 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaa

SEQ ID NO: 434963 - DNA, 4520 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434964 - DNA, 1891 bp, Homo sapiens
aaggtttccgtaggtgaacctgcggaaggatcattaaatatccagcacaaagcgtgtaaataaaataaatagcatgttgtctttatcttcaaaggcattatattgtacttctagcaagtgcaccaacagaaaaacaacgcctggaatggtgagtataagaatagactttacagaaaaagcaaacttcaaaatgaatcacatagccactgaacacagtaggagatgggaggaagtccttaaaacttctagtttggtttgatttgttcacaaatggagctttactgtgtgtagtggaagtacagaaatcaggagatccatatgcaacttatttttttgtttgctttatggagatccgtgcataatttcttaattgtatatttaaagtgcacttatagcttgtttttcttaaaatttttgtgtggataacttttgtaaccttgctggtgtgaatggagtgtttcttggctcttttttccccgttgtttggcaattttgggtagaacataaggcttctggttttatctgtgggagttcagctagttgaaatgccctggtatgtgcattttatttatttatttttaagttaaccaaaactttttgttaatactaagtgacatttgttcagggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagcattcaacagaaggtgtcaaattgacagctctcaatgacagcagcctcgacttgtctatggacagtgataacagcatgtctgtgccttcacctactagtgctacgaagaccagtccattgaacagttctggcagctctcaggggtaaggaaaaagagggaaatagaagtggaggggctgtttgctaaatcaatcagatacattctctttttgctattaaagtcatctatttagaatgttattttcattccatctactaatttttttttaaatagcaatttaattcccaggtttggggatagtactttttggttttgtcttgtcatacttaacattttatttttgagactgataatgtcttcagtcagatgtgaatgaatgttagcacataacccctccaaattcatgtatttagatagctactgctacagtgcactgtatggtgtgctgatgagaacagacaaaaggaacaaaaccacctttctgtcccagagctgcttatacctttgtaacagggaatgtgtctatgatagttagggaaacctgttttagaagagctagatatctgtctaacatttacagcagttaaaattttaaaaatttattattattttgagaaatggggtctggctgtgttgtttaggctggccttgagttcctggatttaagcgatcctcctacttcaaccttctgagtagctgagactacaggcgcatgccactgccctgggtatgaagcagtgaaaaattttcagccaggtgcagtgactcacacctgtaatcccaacacttggggaggctgaggtggtaggatcacttgaggccaggagttcaagaccagcctgggcaacgtagtgagactcccatctctagaaaaaagtaaaagaattaggtgtggtggtatgcacctgtagtcgtggccactcaggaggctgaggtgggaggattgcttgaacctgcaaggttgagactacagtgagctgtgatcccactgctgtaccccagcctgggcaaccagagtgagaccctgtcttaaaa

SEQ ID NO: 434965 - DNA, 1019 bp, Homo sapiens
  misc_feature (159)..(159): n is a, c, g, or t
tgagcggtgccttgcttatgactaatagggaaggaggagaagcgcttaaagcgagcggcgagcggattcgggacgaggtgtttgaccctaggtgttgatggtcatggccactaccgcacatctctcatcgcctgccctcacgattcggatcgattgccncgattgcggacagtgtcagccgcgtagtcgtgtatgctcgtgagtgacaaagttgaacttgggccggtcgtctttaccacggagaccgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgac

SEQ ID NO: 434966 - DNA, 359 bp, Homo sapiens
ccggtccatcagcgtccatcagcggatttctatacattgacctcttgttggttatcaaatagcagtcaacgacgtgtcacacaatgatgtggtttgagggactgatgggagaagactgcgccagtcttctcctatcagcttagcagcccccaaggagactgactgcgtacttacacagaaactaattgagacattgaaaccctttggggtttttgaagaggaagaggaactgcagcgcaggtaaatagatattctatatttttttaactcggaaacttttattaatgttgacataaactaattttgaggcattctctacttacttagaagaccagggttatttgcccagatctatatat

SEQ ID NO: 434967 - DNA, 1375 bp, Homo sapiens
aattaatacattttgtgcttttattcagctcatcttgtggtaaaaggagtttgctcaggcaatgaattatgtcagattaggaataggtcttgaccgatctacagatatgcagtattgatggaaaaaggatccctacttagaatagtttctctggagtgagtataactgcctttattaaaatgtttctatttcttgtaacaatttcctaattgtatagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcaggggtaaggaaaaagagggaaatagaagtggaggggctgtttgctaaatcaatcagatacattctctttttgctattaaagtcatctatttagaatgttattttcattccatctactaatttttttttaaatagcaatttaattcccaggtttggggatagtactttttggttttgtcttgtcatacttaacattttatttttgagactgataatgtcttcagtcagatgtgaatgaatgttagcacataacccctccaaattcatgtatttagatagctactgctacagtgcactgtatggtgtgctgatgagaacagacaaaaggaacaaaaccacctttctgtcccagagctgcttatacctttgtaacagggaatgtgtctatgatagttagggaaacctgttttagaagagctagatatctgtctaacatttacagcagttaaaattttaaaaatttattattattttgagaaatggggtctggctgtgttgtttaggctggccttgagttcctggatttaagcgatcctcctacttcaaccttctgagtagctgagactacaggcgcatgccactgccctgggtatgaagcagtgaaaaattttcagccaggtgcagtgactcacacctgtaatcccaacacttggggaggctgaggtggtaggatcacttgaggccaggagttcaagaccagcctgggcaacgtagtgagactcccatctctagaaaaaagtaaaagaattaggtgtggtggtatgcacctgtagtcgtggccactcaggaggctgaggtgggaggattgcttgaacctgcaaggttgagactacagtgagctgtgatcccactgctgtaccccagcctgggcaaccagagtgagaccctgtcttaaaa

SEQ ID NO: 434968 - DNA, 1525 bp, Homo sapiens
gtactctgttgctagtgatttaggtttcatggcctaacccaaattaattttgatcctgttattctttagtaatgctttcagcattgctgagatcagaaggactactttggtacaattttatattagcatagcttgttactgtgctcttgaagagcagttcttggaaactttagtggattaagtcttccgcagtatatgtgggaagttttaattgtgaatctgaagttcaaattggggcaggttacagtttactttggtttctttggtcagtgcttacaataggagataaatgctttagattttttccccctctttattgaattagctttactggttctaccaaataaaaatttatgtttacttttaacttcaatctcagaaaatttggaagcattaccattaaacttttgatgatttaatgttgtttttttttgttttgttttgttttgtgtgtgtgtgtgtgtgtgtgtttttttttacccctattaattaggttgcagggtaaccgatgaaattttacatctagtaccaaacattgacaacttcaggttaactctgagagctatcaaactatgggccaaacgtgagttcagaatttgttggctagcttattaaaaatgttcaaacttttgttcaacactaacttatctttttgcttttcccttatcaacaggccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctcagcttggtttcagattcaaattttagttcatgatgtagtcatgtaggcagccttggagatcacattgtgtataaaatggcaaactgaaactattttttttccctagtttggccaggatagtaaggcagattctatttgtacttccttgcataaacttaccctctgaataaactctgaattttagcagctaagatccaatttattgataggttgggaaatcagttactatacttttggataaaacttgtacacactacctctttcactcttttaattctctatctataggccattagtttcttgtgattgttttttttttctttttgctttcagcatttatttggcctaatattaaagatacgaattttcataagaagcttttaaagaataaattaacattaagtgcttcgggacaaaaaaggaatttgagattagtcattaacccagatttttttaagtttcttcgtttcatttccacatatgtcaactatgatttaagaaaaagtagaataaaagattactgccattttatattaattgccttggcccaaaaggtgagggttcttggtttttaatcaaattaagatgaaatcgtccgattcctgttcttatgaactcctgctcctccctctgcaaaa

SEQ ID NO: 434969 - DNA, 4650 bp, Homo sapiens
  misc_feature (4545)..(4546): n is a, c, g, or t
  misc_feature (4553)..(4553): n is a, c, g, or t
  misc_feature (4555)..(4555): n is a, c, g, or t
  misc_feature (4560)..(4560): n is a, c, g, or t
  misc_feature (4562)..(4563): n is a, c, g, or t
  misc_feature (4566)..(4567): n is a, c, g, or t
  misc_feature (4578)..(4578): n is a, c, g, or t
  misc_feature (4583)..(4583): n is a, c, g, or t
  misc_feature (4586)..(4586): n is a, c, g, or t
  misc_feature (4590)..(4590): n is a, c, g, or t
  misc_feature (4593)..(4594): n is a, c, g, or t
  misc_feature (4598)..(4598): n is a, c, g, or t
  misc_feature (4600)..(4600): n is a, c, g, or t
  misc_feature (4607)..(4607): n is a, c, g, or t
  misc_feature (4610)..(4610): n is a, c, g, or t
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaaaaaaaaaaaaaaaaaaagggggggnnaaaatcncngggcncnncgnncctttgaaggnccaanggngtanaannaggngnggaaacnggngaaacctggttgggcccctctggggaaggacaccccaaag

SEQ ID NO: 434970 - DNA, 5077 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaaaaaaaaaaaaaaaaaaaaaaaaaaaaaaaaaaaaaaaaaaaaaaaaaaaaaaaaaaaaaaaaaagaggggggggggcgaaaaaaattcccccggggggcgcgcaccaccacataatcgcgcagatcgcagcccaatattgtgttgaacaacaagaggggccccccaaaatggggggagcgactgtaaaaatataaacaggagcagcgggggccgcgcggagataaacaaccacgagggcagcatgagggagaaaaaaccgcggacgacgacgggaactacatgtgggggagaagaggagaaccaccacacatccgcggggggacgagggaaacaatatgtgtggggaacacaaacttgttctagctgagggaggagtatttataagcggctctgtgagggggagcaaatatataaaagtatttgacgaggaggtttaatgatgttgggtgtcaacacaaaccaggggaaagtttgttggtgtggagggatgtgaagaaaattttgtggacaaagggagagtatattatattagaaacaaatttttatacacgcgggt

SEQ ID NO: 434971 - DNA, 4435 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtatttctccattgaaaacacaataaaaaaaaacagcacaa

SEQ ID NO: 434972 - DNA, 4457 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434973 - DNA, 4382 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434974 - DNA, 4997 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatggtgagtataagaatagactttacagaaaaagcaaacttcaaaatgaatcacatagccactgaacacagtaggagatgggaggaagtccttaaaacttctagtttggtttgatttgttcacaaatggagctttactgtgtgtagtggaagtacagaaatcaggagatccatatgcaacttatttttttgtttgctttatggagatccgtgcataatttcttaattgtatatttaaagtgcacttatagcttgtttttcttaaaatttttgtgtggataacttttgtaaccttgctggtgtgaatggagtgtttcttggctcttttttccccgttgtttggcaattttgggtagaacataaggcttctggttttatctgtgggagttcagctagttgaaatgccctggtatgtgcattttatttatttatttttaagttaaccaaaactttttgttaatactaagtgacatttgttcagggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434975 - DNA, 4420 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaatggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434976 - DNA, 4511 bp, Homo sapiens
accccctggagcctgctgtctcctcctgttgtccaggctacaatgcaggggcatgattgtagcttactgtaacctcaaactcctgggttcaagcaattctcctgcctcagccctgggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434977 - DNA, 4310 bp, Homo sapiens
gtatccaattttgtttatagtccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434978 - DNA, 4725 bp, Homo sapiens
cggacgcgtgggcgaccacgcgtccggaattaaaagtacttttatacctactttcccccaacattctttgaagagggaaggtatacatttctgtgaaagaccttaggtatttcaaattcttcgcgagttagttcaagtgtgtaaaatggaagacggggccaggcgcggtggttcacgcctgtaatcccagcactttgggaggcccaggcaggtaaatcgcttgaggccaggagtttgagatcagcctgggcaacatggcgaaacttcatctcaacaaaaaacacaagttagctgggcgtggtggctcatgcctgtaatcccagctacttgggaggttgaggtgggaggactgcttgagcccaggaggctgaggctgcagtgagccttgatcatgccactgcgttccagcctgggtgacagagcgagactcaaaaatccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434979 - DNA, 4545 bp, Homo sapiens
  misc_feature (159)..(159): n is a, c, g, or t
tgagcggtgccttgcttatgactaatagggaaggaggagaagcgcttaaagcgagcggcgagcggattcgggacgaggtgtttgaccctaggtgttgatggtcatggccactaccgcacatctctcatcgcctgccctcacgattcggatcgattgccncgattgcggacagtgtcagccgcgtagtcgtgtatgctcgtgagtgacaaagttgaacttgggccggtcgtctttaccacggagaccgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434980 - DNA, 4312 bp, Homo sapiens
cctttagtacctattgacagtgggctatctctgctgtccggtccggaagtcctgtatcgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434981 - DNA, 2303 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagagatgaaacaagtgaagatgctaactgtctgctttgagtgacacgaatgttcaggtacaagctcggttctatatgtaca

SEQ ID NO: 434982 - DNA, 2779 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcaggggtaaggaaaaagagggaaatagaagtggaggggctgtttgctaaatcaatcagatacattctctttttgctattaaagtcatctatttagaatgttattttcattccatctactaatttttttttaaatagcaatttaattcccaggtttggggatagtactttttggttttgtcttgtcatacttaacattttatttttgagactgataatgtcttcagtcagatgtgaatgaatgttagcacataacccctccaaattcatgtatttagatagctactgctacagtgcactgtatggtgtgctgatgagaacagacaaaaggaacaaaaccacctttctgtcccagagctgcttatacctttgtaacagggaatgtgtctatgatagttagggaaacctgttttagaagagctagatatctgtctaacatttacagcagttaaaattttaaaaatttattattattttgagaaatggggtctggctgtgttgtttaggctggccttgagttcctggatttaagcgatcctcctacttcaaccttctgagtagctgagactacaggcgcatgccactgccctgggtatgaagcagtgaaaaattttcagccaggtgcagtgactcacacctgtaatcccaacacttggggaggctgaggtggtaggatcacttgaggccaggagttcaagaccagcctgggcaacgtagtgagactcccatctctagaaaaaagtaaaagaattaggtgtggtggtatgcacctgtagtcgtggccactcaggaggctgaggtgggaggattgcttgaacctgcaaggttgagactacagtgagctgtgatcccactgctgtaccccagcctgggcaaccagagtgagaccctgtcttaaaa

SEQ ID NO: 434983 - DNA, 2007 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtactccttgtatttttcaagagctattttgtaaacagatgatgtatttctccattgaaaacacaataaaaaaaaacagcacaa

SEQ ID NO: 434984 - DNA, 1282 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaaaaaaaaaaaaaaaaaaaaaaaatttgggggggcgtggctcggaaatttttaaccattgtggggggggccaaggtagaatgggaaagggtcagaaacgggcgtgaaggggggggtcccaaaaaagcgggggcgggttggaacacggggtgggtttggtaaaggcagaacaccgggcgg

SEQ ID NO: 434985 - DNA, 1662 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaaaaaaaaaaaaaaaaaaaaaaaaaaaaaaaaaaaaaaaaaaaaaaaaaaaaaaaaaaaaaaaaaagaggggggggggcgaaaaaaattcccccggggggcgcgcaccaccacataatcgcgcagatcgcagcccaatattgtgttgaacaacaagaggggccccccaaaatggggggagcgactgtaaaaatataaacaggagcagcgggggccgcgcggagataaacaaccacgagggcagcatgagggagaaaaaaccgcggacgacgacgggaactacatgtgggggagaagaggagaaccaccacacatccgcggggggacgagggaaacaatatgtgtggggaacacaaacttgttctagctgagggaggagtatttataagcggctctgtgagggggagcaaatatataaaagtatttgacgaggaggtttaatgatgttgggtgtcaacacaaaccaggggaaagtttgttggtgtggagggatgtgaagaaaattttgtggacaaagggagagtatattatattagaaacaaatttttatacacgcgggt

SEQ ID NO: 434986 - DNA, 1461 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatactaaaaaacc

SEQ ID NO: 434987 - DNA, 2484 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatggtgagtataagaatagactttacagaaaaagcaaacttcaaaatgaatcacatagccactgaacacagtaggagatgggaggaagtccttaaaacttctagtttggtttgatttgttcacaaatggagctttactgtgtgtagtggaagtacagaaatcaggagatccatatgcaacttatttttttgtttgctttatggagatccgtgcataatttcttaattgtatatttaaagtgcacttatagcttgtttttcttaaaatttttgtgtggataacttttgtaaccttgctggtgtgaatggagtgtttcttggctcttttttccccgttgtttggcaattttgggtagaacataaggcttctggttttatctgtgggagttcagctagttgaaatgccctggtatgtgcattttatttatttatttttaagttaaccaaaactttttgttaatactaagtgacatttgttcagggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtactccttgtatttttcaagagctattttgtaaacagatgatgtatttctccattgaaaacacaataaaaaaaaacagcacaa

SEQ ID NO: 434988 - DNA, 2512 bp, Homo sapiens
gaggcgatctagaggatcccgccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434989 - DNA, 1771 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctcagcttggtttcagattcaaattttagttcatgatgtagtcatgtaggcagccttggagatcacattgtgtataaaatggcaaactgaaactattttttttccctagtttggccaggatagtaaggcagattctatttgtacttccttgcataaacttaccctctgaataaactctgaattttagcagctaagatccaatttattgataggttgggaaatcagttactatacttttggataaaacttgtacacactacctctttcactcttttaattctctatctataggccattagtttcttgtgattgttttttttttctttttgctttcagcatttatttggcctaatattaaagatacgaattttcataagaagcttttaaagaataaattaacattaagtgcttcgggacaaaaaaggaatttgagattagtcattaacccagatttttttaagtttcttcgtttcatttccacatatgtcaactatgatttaagaaaaagtagaataaaagattactgccattttatattaattgccttggcccaaaaggtgagggttcttggtttttaatcaaattaagatgaaatcgtccgattcctgttcttatgaactcctgctcctccctctgcaaaa

SEQ ID NO: 434990 - DNA, 2329 bp, Homo sapiens
acccacgggggcgaaagaggcgggcgggggagaggaggatgagggagtgggagaagagaaaactcttgctttgagtggacatgatacaacagaagcaagaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434991 - DNA, 2255 bp, Homo sapiens
ccgtctctactaataacatacataatataaataaagttagttcgggcgtggttgtcacctcataaagaagagagtcccaagaaaaccaaaacagaagagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434992 - DNA, 1076 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgac

SEQ ID NO: 434993 - DNA, 1418 bp, Homo sapiens
cggacgcgtgggcgaccacgcgtccgtatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434994 - DNA, 1644 bp, Homo sapiens
ggcatcgcgttgctcgcaataggtgtattgatcatgctctctaaaccgtagtggcctagaaggtatctcgatctacaactcctattaggtttctgtccactttaaaacatgccgcgtcaactctagcgtacttttgacatccagaatgaatattctagagagactatacacttgggtatctgatcaaggcgattcagagatctcaagcagagtcgtactgatattcggatattactgccatcggaccctgtgtatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaacagcacaa

SEQ ID NO: 434995 - DNA, 802 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatatgttgtctgccgacttagcctgccgaccattcctcaagattggatctacgaggtgatcctgtgcgagtgatccctgca

SEQ ID NO: 434996 - DNA, 966 bp, Homo sapiens
agcggagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgac

SEQ ID NO: 434997 - DNA, 697 bp, Homo sapiens
aagataatttttctttgatttcagtggctttggttctttagaatcatcattaaggacattgactatcaatgcacagttagtaagagtatatttctcctggatctctgtttatgttgtagtaggaatatagaggacaggtgtgggtgaggactttgcgttttcatggagcttgggcttagaacttttagtttgctcatacatttgtattgtaagtttttccatgtctctgattgtcagccacactgatagctacattttcatgaaatccagataaactatggtaatgctcttctttgcagggaagaatttcgcacgatgtgggtgattgggttagtgtttaaaaaaacagaaaactctgaaaacctcagtgttgatctcacctatgatattcagtctttcacagatacaggtatgtctttacttggataatcaaaacacttcagttcttgcatatttcaaattgtcttgatgcataccatagtgatatttacaataattgttgaaattacttgcgaatattgaactatcatcagaataatggttttgtattagtctaatacagattgagtattccttatccacaatgcttgggaccagaagtgtttaggattttttcagattttggaatatttacattacacttaccagttgagcatccctagtctgaaaatatgaaatttgaaatacttcagtgagc

SEQ ID NO: 434998 - DNA, 295 bp, Homo sapiens
aattaagctgctttttggtaattattcataaagtcactgcctttttcagaagaattaaactcactagtagttagaaacatggaatttagcatatatgattttatgtgcatattgagattgtagtcccccttgctaaattgatgtggatctataactgtaaggaagcttattactttatggtttaatatccagcacaaagcgtgtaaataaaataaatagcatgttgtctttatcttcaaaggcattatattgtacttctagcaagtgcaccaacagaaaaacaacgcctggaatg

SEQ ID NO: 434999 - DNA, 2463 bp, Homo sapiens
tgtggtggtttccggcggaggtggtgagagtcgcacgcgcagcggggaaggtgtgagtcgtgaacggcccgggtctccgccatggcctctctactcgccaaggacgcctacctgcagagcctggccaagaagatctgctcccattcggccccggaacagcaggcgcgcacgcgggctggcaaaactcaaggctcagaaactgcagggcccccaaaaaagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttacgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagagcaagactgtctcaaaaagaaaaaatttaagatttgtggaacagagctaaagcagcacaaaaaaacatagcccctaaatgtatgtgcatctacagataaatagtgccatttatacacaca

SEQ ID NO: 435000 - DNA, 2168 bp, Homo sapiens
cttttggggtcatttgctttttggggaacatcatggtggaacattgaactccgcgggccccttgtttgcgtgaggattttctcacctgccttccagccctgattcttctcgactatgggccaggctgggggaccctgggatcgagagaactttaatgagtgggtgcctctttcccccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttacgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagagcaagactgtctcaaaaagaaaaaatttaagatttgtggaacagagctaaagcagcacaaaaaaacatagcccctaaatgtatgtgcatctacagataaatagtgccatttatacacaca

SEQ ID NO: 435001 - DNA, 2031 bp, Homo sapiens
  misc_feature (11)..(11): n is a, c, g, or t
tgggcttttgncgcggaacccaggacctttctcaccccacgtatcacccctagagacactcacagcaagcagcaaccggggaaaaggacgaaaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttacgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagagcaagactgtctcaaaaagaaaaaatttaagatttgtggaacagagctaaagcagcacaaaaaaacatagcccctaaatgtatgtgcatctacagataaatagtgccatttatacacaca

SEQ ID NO: 435002 - DNA, 872 bp, Homo sapiens
tgtggtggtttccggcggaggtggtgagagtcgcacgcgcagcggggaaggtgtgagtcgtgaacggcccgggtctccgccatggcctctctactcgccaaggacgcctacctgcagagcctggccaagaagatctgctcccattcggccccggaacagcaggcgcgcacgcgggctggcaaaactcaaggctcagaaactgcagggcccccaaaaaagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgcgtgacggaggactacggaagtggtgaggctgaggacaggaaccggtggaaatggcgccagagagggagcgccaatgggggaaataatggcccccctaaagggg

SEQ ID NO: 435003 - DNA, 295 bp, Homo sapiens
gtcttgctctgtcactcaggctggagtgcagtggcatttcatatttggaatttttaaaacacacttataaattacctatgagttaaagaattccgaatggctattagaaatatttgggactaaaggataatgaaaatgctacgtattaaaatttgtggaacagggcctggcatggtggctcatgctgtcaatcccagctctttgggaggcgggtggatcacttgagatcaggagttcaaggccagcctggccaacatgataaaaccccatctctattaaaaataaaaaattagct

SEQ ID NO: 435004 - DNA, 909 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcaggtaagtttctcaatctagaatgtaaactacttttacattcaaaattgagttctgtgatctcctgttctatttaaaatgtttagtatacgagga

SEQ ID NO: 435005 - DNA, 1100 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtaaggaaactgtaaccagagaggttaagggatttactgagtctagaggctttcctttattctgtgacatatttgttgttatcatctttgttttatggataggaaaattgtcacgagattaagagatttacccaaggacactcagctagtgacctcaatttgaacccaaattttctggctccagagatcatgctttatttactgtagtactctgcttctatattagcccttcactgagcaaatttaaagtttttgaatgctctgcctactagctagcaaagctaaccttatttcttccatgttgctacccacaaaagatgaaagagaagtcttcactgtggggttgatggtagatata

SEQ ID NO: 435006 - DNA, 1034 bp, Homo sapiens
tttgcaaatatttacatatttaaataaaagtgttacatcaattttgaaatgtatccaacagaatataaatatcgtaggattttaaatatcacctacttaaaaaagatgtgcatgaactcttcactaaccattataatttttacattgcttcttccttgaatttttatttttattcctcttctacagaattttatcctaatataatatatttttaggtttaaaaacttcctactaggctgggcacattggctcacgcctgtaattccagctctttgggaggccgaagcaggcagatcaattgatgttcttaaccatcatcctagtactaggagtttgagaccagcctgttcaacatagtgaaatcctgtctctacaaaaaaatacaaaaacaaaattagctgggcgtgatggcgcccacctgtggtcccagctacttgggaggctgaggtgggaggatcgctggagccccgggggggaggttgcagtgagccaagatcatgccattgcactccagcctggatgacagagtgagaccctatatcaaaaaacaaacaaacaaacaaatgaaagagagaaaacttctagcgaatcatcttattcattaaaattaaaatatttaaaaattttctgtgattttttgtttggatcaacttgttataataatgatacacagttgatcaaaacagcataaacatgttgcaaattatttttaaacaaaaagatgtaaaatgttattggaaatgcatctttggaacagatacggtagaatgtatttttggacctttgagtaaaggatagttccctaaatccaatattttgagctatccctttgtttggcacttcagaggctttcacacctcagggaaatatgccatcataagactcggggtatcctggatggtaggtatgctttactgttaacaagtgggagaaatgaccacagtgaggagaagtgggaagggaaactggtaggatgcttccagtgtagcatggtatcaggcaaatttgttttacaaagagtatttagggaatta

SEQ ID NO: 435007 - DNA, 1332 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435008 - DNA, 1629 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaaaaaaaaaaaaaaaaaaaaaaaaaaaaaaaaaaaaaaaaaaaaaaaaaaaaaaaaaaaaaaaaaaaaaaaaaaacaaaaaacaagaagaaagacgacaagacacagaccaaacagacatggagaacagcgaatagcaaaacaaagaaagaaagacgagaaagggggcgaggaacaagcaacaacacacggacaggagagcggaagaagaaacgagccgaggagcagaaaatcaaaagagccgaaggcaaagagcgaaggcagaaaacgaaagcagaggaggaggacaaaacagacggggagaggaagagaaagaacgaagaaagaaagtagaaaagagaaaaaagagagagagagagaaagagaaacaaaaaaa

SEQ ID NO: 435009 - DNA, 1264 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaagtgtcctgaagtgtcaggataccgagctctacattcg

SEQ ID NO: 435010 - DNA, 2743 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagagacagagtcttgctctgttgcccaggctggagtgcagtggctcaatcttggctcactgcaacgtctgcctcccaggttcaagcgattctcgtgcctcagcctccccagtagctgggactacaggcacacaccaccatgcccgggtaacttgtatttttagtagagatggggtttcgccattttagtcaggctagtcttgaactcttcaggtgatccacctgcttcggcctcccagagtgctggaattacaggcgtgagccactgtgcctggctggcctcagctttaaataagtgataaacctgctgaagtcagagataccatcctttttcctggttcaactctctggttttctaggactctgctactacaaggttttttaaatttcaattaccatacattagtctattctaataatcttccaataatgcaaacttttactcaggattttggtagaatatcaggaaaaccatttcctggtataatgattctctgtaatagagaaatcctatatatcatgtagggtgaagggtagtttttatgtaatagttcactttgagctgtctagcagctgtctagaagctttcatagacacagacaggtagagagaaagacagggtagatgtcttaaccattatccttgttctagggttttcagtcaactctatctcaaaggactgcttctagaggccagcaagagaatagacatttgttttctgtcttgtagaacagaaacaggatatgaagtatacttttgccctttaggtggatttttttcttttctaacagtaaaattatggatatgccttgtagttattgtcatgggattgaacagtgacacaccctcaagatgtaaggaatttattcaactgattgtccaaaaggttttccaaatcttataaactgtaagtcattgagccttaaaattagaataaagcttagagatccatctacctcttcttaccaggaaaaaaatcaagacctaaggaagttgagagtaagatacgcaactaattagtgcaaaactgaaactagaatctaggtcttccatacattctgtcacatggttgttctcttcctcccatcctaccccagctccagtcaactgtatcattttgtattaggcatttttgttttggaaattgtttctcctattttatgagaaggattgtgtagtttcatgtaacttttattattcatactgtaaattgtgtctctttcaaaagtagattgtttctaaaccatagtgtgtaaaaattaagcaaatgtaattttaagaggaatctcattcttggtagcctattatgtaaacatttaggtgggattccagattcagatttgaaacttaaaacctgaaaggcccattgagaaggccagtatctgcattatcattcatgtaatctctctacattatacagaagtgctccaagaatgagaaaaaaatacattgagcaaatgaaatgttaaaatgtacatctgcaataacctcattggactcttaaaaaatattgtgttttaacgtatttcttctttctgttttaggatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435011 - DNA, 1461 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagagacagggtcttgctctgttgcccaggctggagtgcagtggcgtgatcataactcattgcagcctcgaattcctgggttcaaacaatcttcctgcctcagctcccatccagtatgggatattttaaaagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435012 - DNA, 2688 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccatttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagagacagagtcttgctctgttgcccaggctggagtgcagtggctcaatcttggctcactgcaacgtctgcctcccaggttcaagcgattctcgtgcctcagcctccccagtagctgggactacaggcacacaccaccatgcccgggtaacttgtatttttagtagagatggggtttcgccattttagtcaggctagtcttgaactcttcaggtgatccacctgcttcggcctcccagagtgctggaattacaggcgtgagccactgtgcctggctggcctcagctttaaataagtgataaacctgctgaagtcagagataccatcctttttcctggttcaactctctggttttctaggactctgctactacaaggttttttaaatttcaattaccatacattagtctattctaataatcttccaataatgcaaacttttactcaggattttggtagaatatcaggaaaaccatttcctggtataatgattctctgtaatagagaaatcctatatatcatgtagggtgaagggtagtttttatgtaatagttcactttgagctgtctagcagctgtctagaagctttcatagacacagacaggtagagagaaagacagggtagatgtcttaaccattatccttgttctagggttttcagtcaactctatctcaaaggactgcttctagaggccagcaagagaatagacatttgttttctgtcttgtagaacagaaacaggatatgaagtatacttttgccctttaggtggatttttttcttttctaacagtaaaattatggatatgccttgtagttattgtcatgggattgaacagtgacacaccctcaagatgtaaggaatttattcaactgattgtccaaaaggttttccaaatcttataaactgtaagtcattgagccttaaaattagaataaagcttagagatccatctacctcttcttaccaggaaaaaaatcaagacctaaggaagttgagagtaagatacgcaactaattagtgcaaaactgaaactagaatctaggtcttccatacattctgtcacatggttgttctcttcctcccatcctaccccagctccagtcaactgtatcattttgtattaggcatttttgttttggaaattgtttctcctattttatgagaaggattgtgtagtttcatgtaacttttattattcatactgtaaattgtgtctctttcaaaagtagattgtttctaaaccatagtgtgtaaaaattaagcaaatgtaattttaagaggaatctcattcttggtagcctattatgtaaacatttaggtgggattccagattcagatttgaaacttaaaacctgaaaggcccattgagaaggccagtatctgcattatcattcatgtaatctctctacattatacagaagtgctccaagaatgagaaaaaaatacattgagcaaatgaaatgttaaaatgtacatctgcaataacctcattggactcttaaaaaatattgtgttttaacgtatttcttctttctgttttaggatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435013 - DNA, 1922 bp, Homo sapiens
tttgcaaatatttacatatttaaataaaagtgttacatcaattttgaaatgtatccaacagaatataaatatcgtaggattttaaatatcacctacttaaaaaagatgtgcatgaactcttcactaaccattataatttttacattgcttcttccttgaatttttatttttattcctcttctacagaattttatcctaatataatatatttttaggtttaaaaactcccagagtgctggaattacaggcgtgagccactgtgcctggctggcctcagctttaaataagtgataaacctgctgaagtcagagataccatcctttttcctggttcaactctctggttttctaggactctgctactacaaggttttttaaatttcaattaccatacattagtctattctaataatcttccaataatgcaaacttttactcaggattttggtagaatatcaggaaaaccatttcctggtataatgattctctgtaatagagaaatcctatatatcatgtagggtgaagggtagtttttatgtaatagttcactttgagctgtctagcagctgtctagaagctttcatagacacagacaggtagagagaaagacagggtagatgtcttaaccattatccttgttctagggttttcagtcaactctatctcaaaggactgcttctagaggccagcaagagaatagacatttgttttctgtcttgtagaacagaaacaggatatgaagtatacttttgccctttaggtggatttttttcttttctaacagtaaaattatggatatgccttgtagttattgtcatgggattgaacagtgacacaccctcaagatgtaaggaatttattcaactgattgtccaaaaggttttccaaatcttataaactgtaagtcattgagccttaaaattagaataaagcttagagatccatctacctcttcttaccaggaaaaaaatcaagacctaaggaagttgagagtaagatacgcaactaattagtgcaaaactgaaactagaatctaggtcttccatacattctgtcacatggttgttctcttcctcccatcctaccccagctccagtcaactgtatcattttgtattaggcatttttgttttggaaattgtttctcctattttatgagaaggattgtgtagtttcatgtaacttttattattcatactgtaaattgtgtctctttcaaaagtagattgtttctaaaccatagtgtgtaaaaattaagcaaatgtaattttaagaggaatctcattcttggtagcctattatgtaaacatttaggtgggattccagattcagatttgaaacttaaaacctgaaaggcccattgagaaggccagtatctgcattatcattcatgtaatctctctacattatacagaagtgctccaagaatgagaaaaaaatacattgagcaaatgaaatgttaaaatgtacatctgcaataacctcattggactcttaaaaaatattgtgttttaacgtatttcttctttctgttttaggatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435014 - DNA, 1945 bp, Homo sapiens
tgcagatgagcacgagtttatggactctggcctcgcgctgctgcttgatgaagttgatgagcccatggtagaagcgtcgtgagaggtcacttgagcactgccatcaagctcaggctctattttcttagccagctgctttcccagctccactccccactggtcaaagctgttgatgtcccagatgatgccctgaacgaagatcttgtgctcatacatggcgaccaaggctccaagcatgaatggtgtgagcttggtgaacacaatagagttggttgggcgatttccttcaaagaccttatgtggcagcagcctctcaaggtcctctggactcttgcccgcagcctggagctcctttcgggcctcctccgtcgattttcccctcatcagggcctctgtctgggccaagaagttggccaggaggatcttgtgatgcagacccttccgtatggggtgctgggtctggaccgggatgaggaagtcacagggtatcatcttggtgccttgattctctgtaatagagaaatcctatatatcatgtagggtgaagggtagtttttatgtaatagttcactttgagctgtctagcagctgtctagaagctttcatagacacagacaggtagagagaaagacagggtagatgtcttaaccattatccttgttctagggttttcagtcaactctatctcaaaggactgcttctagaggccagcaagagaatagacatttgttttctgtcttgtagaacagaaacaggatatgaagtatacttttgccctttaggtggatttttttcttttctaacagtaaaattatggatatgccttgtagttattgtcatgggattgaacagtgacacaccctcaagatgtaaggaatttattcaactgattgtccaaaaggttttccaaatcttataaactgtaagtcattgagccttaaaattagaataaagcttagagatccatctacctcttcttaccaggaaaaaaatcaagacctaaggaagttgagagtaagatacgcaactaattagtgcaaaactgaaactagaatctaggtcttccatacattctgtcacatggttgttctcttcctcccatcctaccccagctccagtcaactgtatcattttgtattaggcatttttgttttggaaattgtttctcctattttatgagaaggattgtgtagtttcatgtaacttttattattcatactgtaaattgtgtctctttcaaaagtagattgtttctaaaccatagtgtgtaaaaattaagcaaatgtaattttaagaggaatctcattcttggtagcctattatgtaaacatttaggtgggattccagattcagatttgaaacttaaaacctgaaaggcccattgagaaggccagtatctgcattatcattcatgtaatctctctacattatacagaagtgctccaagaatgagaaaaaaatacattgagcaaatgaaatgttaaaatgtacatctgcaataacctcattggactcttaaaaaatattgtgttttaacgtatttcttctttctgttttaggatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435015 - DNA, 2337 bp, Homo sapiens
cctatgcctgaaacatctccaatcctttgaaaagcattttagtccacgctcatggctccttcggttcccacttcagactctttgcagtgcatatggttaaaggacaaagttcacaagaaaaaagtaacatcaaagcaaaaaggcatttattatttgatggttatgatgaaagtatgtgccgtaaatagctcaatatagcagatatttctgctgcccatccctctaagggtcagtataatctttaacttccttctttgcttctccttccctgaaactgaaaatagatactgaaagagtccaaagcctgaattccctgtaagtgcttcttctaacctaaagtttggctctggctgtaagaattattggcctcagctttatctttttctttttcttttttttttttttttttgagacagagtcttgctctgttgcccaggctggagtgcagtggctcaatcttggctcactgcaacgtctgcctcccaggttcaagcgattctcgtgcctcagcctccccagtagctgggactacaggcacacaccaccatgcccgggtaacttgtatttttagtagagatggggtttcgccattttagtcaggctagtcttgaactcttcaggtgatccacctgcttcggcctcccagagtgctggaattacaggcgtgagccactgtgcctggctggcctcagctttaaataagtgataaacctgctgaagtcagagataccatcctttttcctggttcaactctctggttttctaggactctgctactacaaggttttttaaatttcaattaccatacattagtctattctaataatcttccaataatgcaaacttttactcaggattttggtagaatatcaggaaaaccatttcctggtataatgattctctgtaatagagaaatcctatatatcatgtagggtgaagggtagtttttatgtaatagttcactttgagctgtctagcagctgtctagaagctttcatagacacagacaggtagagagaaagacagggtagatgtcttaaccattatccttgttctagggttttcagtcaactctatctcaaaggactgcttctagaggccagcaagagaatagacatttgttttctgtcttgtagaacagaaacaggatatgaagtatacttttgccctttaggtggatttttttcttttctaacagtaaaattatggatatgccttgtagttattgtcatgggattgaacagtgacacaccctcaagatgtaaggaatttattcaactgattgtccaaaaggttttccaaatcttataaactgtaagtcattgagccttaaaattagaataaagcttagagatccatctacctcttcttaccaggaaaaaaatcaagacctaaggaagttgagagtaagatacgcaactaattagtgcaaaactgaaactagaatctaggtcttccatacattctgtcacatggttgttctcttcctcccatcctaccccagctccagtcaactgtatcattttgtattaggcatttttgttttggaaattgtttctcctattttatgagaaggattgtgtagtttcatgtaacttttattattcatactgtaaattgtgtctctttcaaaagtagattgtttctaaaccatagtgtgtaaaaattaagcaaatgtaattttaagaggaatctcattcttggtagcctattatgtaaacatttaggtgggattccagattcagatttgaaacttaaaacctgaaaggcccattgagaaggccagtatctgcattatcattcatgtaatctctctacattatacagaagtgctccaagaatgagaaaaaaatacattgagcaaatgaaatgttaaaatgtacatctgcaataacctcattggactcttaaaaaatattgtgttttaacgtatttcttctttctgttttaggatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435016 - DNA, 1507 bp, Homo sapiens
cctgaggatccccgtctctcgagacggactctctccagcacgggaaaaccatttcctggtataatgattctctgtaatagagaaatcctatatatcatgtagggtgaagggtagtttttatgtaatagttcactttgagctgtctagcagctgtctagaagctttcatagacacagacaggtagagagaaagacagggtagatgtcttaaccattatccttgttctagggttttcagtcaactctatctcaaaggactgcttctagaggccagcaagagaatagacatttgttttctgtcttgtagaacagaaacaggatatgaagtatacttttgccctttaggtggatttttttcttttctaacagtaaaattatggatatgccttgtagttattgtcatgggattgaacagtgacacaccctcaagatgtaaggaatttattcaactgattgtccaaaaggttttccaaatcttataaactgtaagtcattgagccttaaaattagaataaagcttagagatccatctacctcttcttaccaggaaaaaaatcaagacctaaggaagttgagagtaagatacgcaactaattagtgcaaaactgaaactagaatctaggtcttccatacattctgtcacatggttgttctcttcctcccatcctaccccagctccagtcaactgtatcattttgtattaggcatttttgttttggaaattgtttctcctattttatgagaaggattgtgtagtttcatgtaacttttattattcatactgtaaattgtgtctctttcaaaagtagattgtttctaaaccatagtgtgtaaaaattaagcaaatgtaattttaagaggaatctcattcttggtagcctattatgtaaacatttaggtgggattccagattcagatttgaaacttaaaacctgaaaggcccattgagaaggccagtatctgcattatcattcatgtaatctctctacattatacagaagtgctccaagaatgagaaaaaaatacattgagcaaatgaaatgttaaaatgtacatctgcaataacctcattggactcttaaaaaatattgtgttttaacgtatttcttctttctgttttaggatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435017 - DNA, 1277 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccatttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435018 - DNA, 1328 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccacctctgtggagaacacccccccatggaggcgaggtagagttggggtcgcagtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435019 - DNA, 881 bp, Homo sapiens
cggttcgctaagtgcgaggacctcaaagcgggacaatatcctctgtggagaacacccccccatggaggcgaggtagagttggggtcgcagtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435020 - DNA, 1564 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccacccccccatggaggcgagggtcttactctgtcgccctggctggagtacagttggcacggatctcagctcactgcagcctccgcctcccgggttcagtcaattctcctgcctcagcctcctgagtagctgggactacatggcatgcgccacacacccggtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagagacagggtcttgctctgttgcccaggctggagtgcagtggcgtgatcataactcattgcagcctcgaattcctgggttcaaacaatcttcctgcctcagctcccatccagtatgggatattttaaaagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435021 - DNA, 922 bp, Homo sapiens
ggaattggtatataaacattggggaagaaaagtttactttctttgtattaggagctgctgagctgggaatatgtgactctagagctgttggcaattagttagagtgccactctgcagaatgaagacaagcagagctaagcaaggaggcagggaagccaagggcctcagggagcacagaattcagtccttggttcctgtagcttttcttttgatcctttgagctatcccagtatatcccagtagttgtttttagctacatgagccactaaattacctatttttgcttaggttagagctggatttttgttgcttctgaaatacttttattaacaactgagaaaagtaaacaaagtgctgtgaaatatcttttgtaaaatgaataattttgaaattttgtctcttctagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435022 - DNA, 896 bp, Homo sapiens
aaacaaattgaagaaaaagaaactatgacattctcaagtttatactaacatgctttgtgaagaggaatacatttcggaaatatgaaatacgctggataaaacctcagcagacaattttctttgggcaactaatagtaccatgcaactaatgaaaaaactaaaggagtttttattaaggtttgttaaagttttgcactgtagggttttgtggaattgggagcctaattgatttcattcttatttcaatgcagagacagggtcttgctctgttgcccaggctggagtgcagtggcgtgatcataactcattgcagcctcgaattcctgggttcaaacaatcttcctgcctcagctcccatccagtatgggatattttaaaagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435023 - DNA, 936 bp, Homo sapiens
cggttcgctaagtgcgaggacctcaaagcgggacaatatcctctgtggagaacacccccccatggaggcgaggtagagttggggtcgcagaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435024 - DNA, 1258 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttggattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacaaaaaattatacagaactcgtaaaatggtatatgaatgaaaaagagaaatctttaaatccatacactagaagttctctatta

SEQ ID NO: 435025 - DNA, 3919 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435026 - DNA, 1107 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaagtacagtataattttctttttctgcctagaaagcagatactacaaaatagaaattccacttgctgcttccaaagggtgtttctgtaggagttattcttactgggagctggttggcataatgccactgaagggtattttactgttttttttttaccattgctatgactttaggtttgctgtttggctccaaggggatttatgattaagccattaaacctgtaatttggtt

SEQ ID NO: 435027 - DNA, 777 bp, Homo sapiens
cactgaggtaccaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagttcccagccaatgaccccaaggcggggactcaagggaaatgcatgcctttcttccgagctgggttcgtctgccccagtccaccctacaagtccctggcccgagagcagatcaacgctctgacctccttcctggatgccagctttgtgtacagctccgagccaagcctggccagccggctccgcaaactcagcagccccctgggcctcatg

SEQ ID NO: 435028 - DNA, 550 bp, Homo sapiens
cactgaggtaccaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcactgtagtaaacttccagccacctgaatgaaattcacctaatttaacaaactgcacgagaagcaaagcaactcccggagcatacacagcaaacaacgttctaagaattttacatatattgacttatggaagcctgacaacatcactgtgatgtaagtgctattgttatttacattttatggatgaggacaaggaggcactgaacagcaaagtatttgccctggatcaccaggatttgggcaaaggtatgctctgagacctttttccccgccttatgcccattacaaggtaccttgaatgaaaaaatacacaagaacattgcatgga

SEQ ID NO: 435029 - DNA, 7460 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435030 - DNA, 7404 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatcgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435031 - DNA, 7474 bp, Homo sapiens
cactgaggtaccaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435032 - DNA, 7382 bp, Homo sapiens
ggtagatggtgtgcttccagctgataccaggagcagaagttttgagaagagactgtttgtcatgtggatagtggaaagccctgctctctggtaacgaatgaagaaaggctttaaagctgggtgtctacggagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435033 - DNA, 6722 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435034 - DNA, 6782 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta
